(12) United States Patent
Kannan et al.

(10) Patent No.: US 9,822,173 B2
(45) Date of Patent: Nov. 21, 2017

(54) HETERODIMERIC IMMUNOGLOBULINS

(71) Applicant: AMGEN INC., Thousand Oaks, CA (US)

(72) Inventors: Gunasekaran Kannan, Newbury, CA (US); Monica Florio, Thousand Oaks, CA (US); Zhi Liu, Shoreline, WA (US); Wei Yan, Sammamish, WA (US)

(73) Assignee: AMGEN INC., Thousand Oaks, CA (US)

( * ) Notice: Subject to any disclaimer, the term of this patent is extended or adjusted under 35 U.S.C. 154(b) by 0 days.

(21) Appl. No.: 14/443,107

(22) PCT Filed: Nov. 21, 2013

(86) PCT No.: PCT/US2013/071289
§ 371 (c)(1),
(2) Date: May 15, 2015

(87) PCT Pub. No.: WO2014/081955
PCT Pub. Date: May 30, 2014

(65) Prior Publication Data
US 2016/0046705 A1    Feb. 18, 2016

Related U.S. Application Data

(60) Provisional application No. 61/779,439, filed on Mar. 13, 2013, provisional application No. 61/729,148, filed on Nov. 21, 2012.

(51) Int. Cl.
| | | |
|---|---|---|
| *A61K 39/00* | (2006.01) | |
| *A61K 39/395* | (2006.01) | |
| *C07K 16/22* | (2006.01) | |
| *C07K 16/18* | (2006.01) | |
| *C07K 16/28* | (2006.01) | |
| *C07K 16/32* | (2006.01) | |
| *C07K 16/46* | (2006.01) | |

(52) U.S. Cl.
CPC .............. *C07K 16/22* (2013.01); *C07K 16/18* (2013.01); *C07K 16/2863* (2013.01); *C07K 16/32* (2013.01); *C07K 16/468* (2013.01); *A61K 2039/505* (2013.01); *C07K 2317/31* (2013.01); *C07K 2317/34* (2013.01); *C07K 2317/52* (2013.01); *C07K 2317/565* (2013.01); *C07K 2317/567* (2013.01); *C07K 2317/72* (2013.01); *C07K 2317/732* (2013.01); *C07K 2317/75* (2013.01); *C07K 2317/76* (2013.01); *C07K 2317/92* (2013.01); *C07K 2317/94* (2013.01); *C07K 2319/00* (2013.01)

(58) Field of Classification Search
None
See application file for complete search history.

(56) References Cited

U.S. PATENT DOCUMENTS

| | | |
|---|---|---|
| 4,331,647 A | 5/1982 | Goldenberg |
| 4,376,110 A | 3/1983 | David et al. |
| 4,411,993 A | 10/1983 | Gillis |
| 4,427,115 A | 1/1984 | Laipply |
| 4,543,439 A | 9/1985 | Frackelton, Jr. et al. |
| RE32,011 E | 10/1985 | Zimmerman et al. |
| 4,837,440 A | 6/1989 | Burtscher et al. |
| 4,902,614 A | 2/1990 | Wakabayashi et al. |
| 5,070,108 A | 12/1991 | Margolis |
| 5,145,684 A | 9/1992 | Liversidge et al. |
| 5,223,409 A | 6/1993 | Ladner et al. |
| 5,399,363 A | 3/1995 | Liversidge et al. |
| 5,453,492 A | 9/1995 | Butzow et al. |
| 5,466,468 A | 11/1995 | Schneider et al. |
| 5,543,158 A | 8/1996 | Gref et al. |
| 5,552,157 A | 9/1996 | Yagi et al. |
| 5,565,213 A | 10/1996 | Nakamori et al. |
| 5,567,434 A | 10/1996 | Szoka, Jr. |
| 5,571,714 A | 11/1996 | Dasch et al. |
| 5,627,052 A | 5/1997 | Schrader |
| 5,641,515 A | 6/1997 | Ramtoola |
| 5,698,426 A | 12/1997 | Huse |
| 5,738,868 A | 4/1998 | Shinkarenko |
| 5,780,263 A | 7/1998 | Hastings et al. |
| 5,795,587 A | 8/1998 | Gao et al. |
| 5,795,965 A | 8/1998 | Tsuchiya et al. |
| 5,811,238 A | 9/1998 | Stemmer et al. |
| 5,830,721 A | 11/1998 | Stemmer et al. |
| 5,837,458 A | 11/1998 | Minshull et al. |
| 5,877,397 A | 3/1999 | Lonberg et al. |
| 6,054,561 A | 4/2000 | Ring |
| 6,057,421 A | 5/2000 | Muller et al. |
| 6,117,911 A | 9/2000 | Grainger et al. |
| 6,133,426 A | 10/2000 | Gonzalez et al. |
| 6,180,370 B1 | 1/2001 | Queen et al. |

(Continued)

FOREIGN PATENT DOCUMENTS

| | | |
|---|---|---|
| JP | 4-141095 | 5/1992 |
| WO | WO-91/13152 | 9/1991 |

(Continued)

OTHER PUBLICATIONS

Gupta et al., 2010, Indian J. Orthop. 44:84-88.*
A diagram of a relevant part of the human genome (D64), citation in Appeal, European Patent No. 1133558, dated Apr. 15, 2010.
Abbas et. al. (Eds.), Cellular and Molecular Immunology, Third Edition, Section II, p. 54 (1997).
Alberts et. al. (Eds.), Molecular Biology of the Cell, Third Edition, Chapter 23, p. 1212 (1994).
Albertsen et. al., A physical map and candidate genes in the BRCA1 region on chromosome 17q12-21. *Nat. Genet.*, 7:472-9 (1994).
Alting-Mees et. al., Monoclonal antibody expression libraries: A rapid alternative to hybridomas. *Strat. Molec. Biol.*, 3:1-9 (1990).
Alves et. al., Sclerosteosis: A marker of Dutch ancestry? *Rev. Bras. Genet.*, 4:825-34 (1982).

(Continued)

*Primary Examiner* — Elizabeth C Kemmerer
(74) *Attorney, Agent, or Firm* — Marshall, Gerstein & Borun LLP

(57) ABSTRACT

The present application is directed to heterodimeric antibodies and methods of use.

19 Claims, 23 Drawing Sheets

(56) References Cited

U.S. PATENT DOCUMENTS

| | | |
|---|---|---|
| 6,207,153 B1 | 3/2001 | Dan et al. |
| 6,344,541 B1 | 2/2002 | Bass et al. |
| 6,395,511 B1 | 5/2002 | Brunkow et al. |
| 6,489,445 B1 | 12/2002 | Brunkow et al. |
| 6,495,736 B1 | 12/2002 | Brunkow et al. |
| 6,703,199 B1 | 3/2004 | Koide |
| 6,803,453 B1 | 10/2004 | Brunkow et al. |
| 6,806,055 B2 | 10/2004 | Berman et al. |
| 6,815,201 B2 | 11/2004 | Pinter |
| 6,818,748 B2 | 11/2004 | Fulton et al. |
| 6,844,422 B1 | 1/2005 | Niehrs et al. |
| 7,057,017 B2 | 6/2006 | McCarthy |
| 7,192,583 B2 | 3/2007 | Brunkow et al. |
| 7,226,902 B2 | 6/2007 | Winkler et al. |
| 7,381,409 B2 | 6/2008 | Winkler et al. |
| 7,572,899 B2 | 8/2009 | Brunkow et al. |
| 7,578,999 B2 | 8/2009 | Winkler et al. |
| 7,592,429 B2 | 9/2009 | Paszty et al. |
| 7,642,238 B2 | 1/2010 | Shaughnessy |
| 7,758,858 B2 | 7/2010 | Brunkow et al. |
| 7,868,134 B2 | 1/2011 | Winkler et al. |
| 7,872,106 B2 | 1/2011 | Paszty et al. |
| 8,178,099 B2 | 5/2012 | Ellies |
| 2003/0165410 A1 | 9/2003 | Taylor |
| 2003/0166247 A1 | 9/2003 | Brunkow et al. |
| 2003/0186915 A1 | 10/2003 | Pan et al. |
| 2003/0229041 A1 | 12/2003 | Sutherland et al. |
| 2004/0009535 A1 | 1/2004 | Brunkow et al. |
| 2004/0023356 A1 | 2/2004 | Krumlauf et al. |
| 2004/0038860 A1 | 2/2004 | Allen et al. |
| 2004/0058321 A1 | 3/2004 | Brunkow et al. |
| 2004/0141875 A1 | 7/2004 | Doshi |
| 2004/0146888 A1 | 7/2004 | Paszty et al. |
| 2004/0158045 A1 | 8/2004 | Brunkow et al. |
| 2005/0014650 A1 | 1/2005 | Seitz et al. |
| 2005/0069915 A1 | 3/2005 | McCarthy |
| 2005/0079173 A1 | 4/2005 | Niehrs et al. |
| 2005/0085418 A1 | 4/2005 | Winkler et al. |
| 2005/0106683 A1 | 5/2005 | Winkler et al. |
| 2005/0238646 A1 | 10/2005 | Ledbetter et al. |
| 2006/0127393 A1 | 6/2006 | Li et al. |
| 2006/0233801 A1 | 10/2006 | Brunkow et al. |
| 2007/0072797 A1 | 3/2007 | Robinson et al. |
| 2007/0110747 A1 | 5/2007 | Paszty et al. |
| 2007/0292444 A1 | 12/2007 | Krumlauf et al. |
| 2008/0182788 A1 | 7/2008 | Brunkow et al. |
| 2008/0234219 A1 | 9/2008 | Brunkow et al. |
| 2009/0074763 A1 | 3/2009 | Padhi et al. |
| 2009/0117118 A1 | 5/2009 | Winkler et al. |
| 2009/0304713 A1 | 12/2009 | Paszty et al. |
| 2010/0015665 A1 | 1/2010 | Latham et al. |
| 2010/0036091 A1 | 2/2010 | Robinson et al. |
| 2010/0151524 A1 | 6/2010 | Winkler et al. |
| 2011/0044978 A1 | 2/2011 | Ke et al. |
| 2011/0097342 A1 | 4/2011 | Paszty et al. |
| 2011/0150866 A1 | 6/2011 | Brunkow et al. |
| 2014/0271654 A1* | 9/2014 | Li ................... C07K 16/22 424/139.1 |
| 2014/0294834 A1* | 10/2014 | Harms ............. C07K 16/2863 424/136.1 |

FOREIGN PATENT DOCUMENTS

| | | |
|---|---|---|
| WO | WO-92/01047 | 1/1992 |
| WO | WO-92/02551 | 2/1992 |
| WO | WO-92/06693 | 4/1992 |
| WO | WO-95/30003 | 11/1995 |
| WO | WO-96/04375 | 2/1996 |
| WO | WO-98/21335 | 5/1998 |
| WO | WO-99/03996 | 1/1999 |
| WO | WO-99/06554 | 2/1999 |
| WO | WO-99/15556 | 4/1999 |
| WO | WO-00/32773 | 6/2000 |
| WO | WO-00/44777 | 8/2000 |
| WO | WO-00/75317 | 12/2000 |
| WO | WO-01/64885 | 9/2001 |
| WO | WO-01/92308 | 12/2001 |
| WO | WO-01/98491 | 12/2001 |
| WO | WO-02/24888 | 3/2002 |
| WO | WO-02/30463 | 4/2002 |
| WO | WO-03/050513 | 6/2003 |
| WO | WO-03/087763 | 10/2003 |
| WO | WO-03/106657 | 12/2003 |
| WO | WO-2004/082608 | 9/2004 |
| WO | WO-2004/094477 | 11/2004 |
| WO | WO-2004/098491 | 11/2004 |
| WO | WO-2005/003158 | 1/2005 |
| WO | WO-2005/014650 | 2/2005 |
| WO | WO-2005/115356 | 12/2005 |
| WO | WO-2006/015373 | 2/2006 |
| WO | WO-2006/065746 | 6/2006 |
| WO | WO-2006/102070 | 9/2006 |
| WO | WO-2006/119062 | 11/2006 |
| WO | WO-2006/119107 | 11/2006 |
| WO | WO-2007/080129 | 7/2007 |
| WO | WO-2008/061013 | 5/2008 |
| WO | WO-2008/092894 | 8/2008 |
| WO | WO-2008/115732 | 9/2008 |
| WO | WO-2008/133722 | 11/2008 |
| WO | WO-2009/039175 | 3/2009 |
| WO | WO-2009/047356 | 4/2009 |
| WO | WO-2009/056634 | 5/2009 |
| WO | WO-2009/079471 | 6/2009 |
| WO | WO 2009/089004 A1 * | 7/2009 |
| WO | WO-2009/131553 | 10/2009 |
| WO | WO-2009/149189 | 12/2009 |
| WO | WO-2010/100179 | 9/2010 |
| WO | WO-2010/100200 | 9/2010 |
| WO | WO-2010/115932 | 10/2010 |
| WO | WO-2010/130830 | 11/2010 |
| WO | WO-2012/028683 | 3/2012 |
| WO | WO-2012/058393 | 5/2012 |
| WO | WO-2012/118903 | 9/2012 |

OTHER PUBLICATIONS

Andersson et. al., Molecular genetics and pathophysiology of 17β-hydroxysteriod dehydrogenase 3 deficiency. *J. Clin. Endocrinol. Metab.*, 81(1): 130-6 (1996).

Angal et. al., A single amino acid substitution abolishes the heterogeneity of chimeric mouse/human (IgG4) antibody. *Mol. Immunol.*, 30(1):105-8 (1993).

Anh et al., Structural Basis of Wnt Signaling Inhibition by Dickkopf Binding to LRP5/6. *Dev. Cell*, 21(5): 862-73 (2011).

Annex EW6 to Declaration filed in connection with the European Patent EP 1133558 Opposition, Expert opinion of Prof. Dr. Edgar Wingender, dated Sep. 24, 2009.

Annex regarding the purported relevance of gene/peptides mentioned by Professor Arnett, dated Mar. 18, 2011.

Anonymous, Amgen presents denosumab and sclerostin antibody data at American Society for Bone and Mineral Research Annual Meeting. Amgen Media Press Release. <www.amgen.com/media/media_pr_detail.jsp?releaseID-907028> (2006).

Anonymous, UCB on track. UCB News <http://hugin.info/133973/R/1176122/233395.pdf> (2007).

Arnett et. al., Effect of pH on bone resorption by rat osteoclasts in vitro. *Endocrinol.*, 119(1):119-124 (1986).

Attana Application Example, cited in Opposition against European Patent No. 1721979 by Opponent: Novartis AG, dated Jun. 15, 2011.

Avsian-Kretchmer et. al., Comparative genomic analysis of the eight-membered ring cystine knot-containing bone morphogenetic protein antagonists. *Molec. Endocrinol.*, 18(1):1-12 (2004).

Babcook et. al., A novel strategy for generating monoclonal antibodies from single, isolated lymphocytes producing antibodies of defined specificities. *Proc. Natl. Acad. Sci. USA*, 93:7843-8 (1996).

Baines et. al., Purification of immunoglobulin G (IgG). *Meth. Molec. Biol.*, 10:79-104 (1992).

Balemans et. al., Extracellular regulation of BMP signaling in vertebrates: A cocktail of modulators. *Dev. Biol.*, 250:231-50 (2002).

(56) References Cited

OTHER PUBLICATIONS

Balemans et. al., Increased bone density in sclerosteosis is due to the deficiency of a novel secreted protein (SOST). *Hum. Mol. Genet.*, 10:537-43 (2001).
Balemans et. al., Localization of the gene for sclerosteosis to the van Buchem disease-gene region on chromosome 17q12-q21. *Am. J. Hum. Genet.*, 64:1661-9 (1999).
Balint et. al., Antibody engineering by parsimonious mutagenesis. *Gene*, 137(1):109-18 (1993).
Bateman et. al., Granulins: The structure and function of an emerging family of growth factors. *J. Endocrinol.*, 158: 145-51 (1998).
Baxevanis (Ed.) et. al., Bioinformatics: A practical guide to the analysis of genes and proteins, John Wiley & Sons, Inc. p. 234 (1998).
Beighton et. al., Heterozygous manifestations in the heritable disorders of the skeleton. *Pediatr. Radiol.*, 27: 397-401 (1997).
Beighton et. al., The clinical features of sclerosteosis. *Clin. Genet.*, 25:175-81 (1984).
Beighton et. al., The syndromic status of sclerosteosis and van Buchem disease. *Ann. Intern. Med.*, 84:393-7 (1976).
Bellows et. al., Parathyroid hormone reversibly suppresses the differentiation of osteoprogenitor cells in functional osteoblasts. *Endocrinol.*, 127(6): 3111-6 (1990).
Bendayan, Possibilities of false immunocytochemical results generated by the use of monoclonal antibodies: The example of the anti-proinsulin antibody. *J. Histochem. Cytochem.*, 43(9):881-6 (1995).
Bendig, Humanization of rodent monoclonal antibodies by CDR grafting. *Methods*, 8:83-93 (1995).
Bergfeld et. al., Release of ATP from human erythrocytes in response to a brief period of hypoxia and hypercapnia. *Cardiovascular Res.*, 26: 40-7 (1992).
Berman et. al., The protein data bank. *Acta. Cryst.*, 58(1):899-907 (2002).
Bigger versions of Figures from Declaration of Professor Teresa Attwood, citation in Appeal, European Pat. No. 1133558, dated Apr. 13, 2010.
Bird et. al., Single-chain antigen-binding proteins. *Science*, 242:423-6 (1988).
Birren et. al., EMBL sequence database accession No. AC003098.2, Nov. 14, 1997.
Bishop (Ed.), Guide to Human Genome Computing, Second Edition, Academic Press, Chapter 1: Introduction to human genome computer via the world wide web, pp. 1-14 (2003).
Black et. al., A somatic cell hybrid map of the long arm of human chromosome 17, containing the familial breast cancer ILocus (BRCAI). *Am. J. Hum. Genet.*, 52:702-10 (1993).
Blum et. al., Study plan for German students in the summer of 1998, University Bioinformatik lecture announcement (1998).
Boden et. al., Glucocorticoid-induced differentiation of fetal rat calvarial osteoblasts is mediated by bone morphogenetic protein-6. *Endocrinology*, 138(7):2820-8 (1997).
Boerner et. al., Production of antigen-specific human monoclonal antibodies from in vitro-primed human splenocytes. *J. Immunol.*, 147:86-95 (1991).
Bonaldo et. al., EMBL Sequence Database Accession No. AI113131, Sep. 4, 1998.
Bonaldo et. al., Normalization and subtraction: Two approaches to facilitate gene discovery. *Genome Res.*, 6(9):791-806 (1996).
Bondestam, Ligands & Signaling Components of the Transforming Growth Factor, Helsinki University Biomedical Dissertations (2002).
Bork et. al., Go hunting in sequence databases by watch out for the traps. *Trends Genet.*, 12: 425-7 (1996).
Bos et. al., Ras ongogenes in human cancer: A review. *Cancer Res.*, 49: 4682-9 (1989).
Bost et. al., Antibodies against a peptide sequence within the HIV envelope protein crossreacts with human interleukin-2. *ImmunoL Invest.*, 17(6&7):577-86 (1988).

Bostrom et al, Variants of the Antibody Herceptin That Interact with HER2 and VEGF at the Antigen Binding Site. *Science*, 323(5921): 1610-4 (2009).
Bostrom et. al., Ligand and signaling components of the transforming growth factor β family. *J. Orth. Res.*, 13:357-67 (1995).
Bottcher et. al., NCBI Sequence database accession No. NM_004329, Aug. 2, 2009.
Bouffard et. al., A physical map of human chromosome 7: An integrated YAC contig map with average STS spacing of 79 kb. *Genome Res.*, 7: 673-92 (1997).
Bowie et. al., A method to identify protein sequences that fold into a known three-dimensional structure. *Science*, 253:164-70 (1991).
Bowie et. al., Deciphering the message in protein sequences: Tolerance to amino acid substitutions. *Science*, 247(4948):1306-10 (1990).
Boyden et al., High bone density due to mutation in LDL-receptor-related protein 5. *N. Eng. J. Med.*, 346:1513-21 (2002).
Bradley et. al., Modifying the mouse: Design and desire. *Bio/Technology*, 10:534-9 (1992).
Brandao-Burch et. al., Acidosis inhibits bone formation by osteoblasts in vitro by preventing mineralization. *Calcif. Tissue Int.*, 77: 167-74 (2005).
Brenner et. al., Population statistics of protein structures: Lessons from structural classifications. *Curr. Op. Struct. Biol.*, 7(3):369-76 (1997).
Brown, Hybridization analysis of DNA blots, *Current Protocols in Protein Science*, 13:A.4H.1-A.4H.9 (1990).
Brown, Hybridization analysis of DNA blots, *Current Protocols in Protein Science*, 2.10.1-2.10.16 (2000).
Bruggemann et. al., Production of human antibody repertoires in transgenic mice. *Curr. Opin. Biotechnol.*, 8:455-8 (1997).
Brunkow et. al., Bone dysplasia sclerosteosis results from loss of the SOST gene product, a novel cysteine knot-containing protein. *Am. J. Hum. Genet.*, 68:577-89 (2001).
Burton et. al., Human antibodies from combinatorial libraries. *Adv. Immunol.*, 57:191-280 (1994).
Büschenfelde et al, Antihuman Epidermal Growth Factor Receptor 2 (HER2) Monoclonal Antibody Trastuzumab Enhances Cytolytic Activity of Class I-restricted HER2-specific T Lymphocytes Against HER2-overexpressing Tumor Cells. *Cancer Res.*, 62(8): 2244-7(2002).
Butcher et. al., Increased salt concentration reversibly destabilizes p53 quaternary structure and sequence-specific DNA binding. *Biochem. J.*, 298: 513-6 (1994).
Byrne et. al., CD4+CD45RBHi T cell transfer induced colitis in mice is accompanied by osteopenia which is treatable with recombinant human osteoprotegerin. *Gut.*, 54:78-86 (2005).
Campbell et. al., Totipotency or multipotentiality of cultured cells: Applications and progress. *Theriogenology*, 47:63-72 (1997).
Carter, Bispecific human IgG by design. *J. Immunol. Meth.*, 248:7-15(2001).
Caverzasio et. al., Characteristics and regulation of Pi transport in osteogenic cells for bone metabolism. *Kindey Int.*, 49: 975-80 (1996).
Chan et. al., A new paradigm in the treatment of osteoporosis: Wnt pathway proteins and their antagonists. *Curr. Opin. Invest. Drugs*, 8:293-8 (2007).
Chandran et. al., Recent trends in drug delivery systems: Liposomal drug delivery system—Preparation and characterization. *Indian J. Exp. Biol.*, 35(8):801-9 (1997).
Charlier et. al., A pore mutation in a novel KQT-like potassium channel gene in an idiopathic epilepsy family. *Nat. Genet.*, 18:53-5 (1998).
Cheng et al, Crystal structures of the extracellular domain of LRP6 and its complex with DKK1. *Nat. Struct. Mol. Biol.*, 18: 1204-10 (2011).
Chenu et. al., Glutamate receptors are expressed by bone cells and are involved in bone resorption. *Bone*, 22(4): 295-9 (1998).
Chothia, The nature of the accessible and buried surfaces in proteins. *J. Mol. Biol.*, 105:1-14 (1976).
Chou et. al., Empirical predication of protein conformation. *Ann. Rev. Biochem.*, 47:251-76 (1979).

(56) References Cited

OTHER PUBLICATIONS

Chou et. al., Prediction of the secondary structure of proteins from their amino acid sequence. *Adv. Enzymol. Relat. Areas Mol. Biol.*, 47:145-8 (1978).

Clark, Antibody humanization: A case of the 'Emperor's New Clothes'?. *Immunology Today*, 21(8):397-402 (2000).

Cogan et. al., NCBI Sequence Database Accession No. NM_033346, Jul. 19, 2005.

Collins, Identifying human disease genes by positional cloning. The Harvey Lectures, Series 86:149-64 (1992).

Collins, Positional cloning moves from perditional to traditional. *Nat. Genet.*, 9:347-50 (1995).

Colman, Effects of amino acid sequence changes on antibody-antigen interactions. *Biomolec. Res. Inst.*, 55:33-6 (1994).

Communication from the European Patent Office providing an "Observation by a Third Party according to Article 115 EPC" submitted in connection with the Opposition to European Patent No. 1 133 558, dated Dec. 3, 2008.

Cook et. al., Structural basis for a functional antagonist in the transforming growth factor β superfamily. *J. Biol. Chem.*, 280(48):40177-86 (2005).

Cormier, Markers of bone metabolism. *Curr. Opin. on Rheu.*, 7:243-8 (1995).

Couvreur et. al., Polyalkylcyanoacrylates as colloidal drug carriers. *Crit. Rev. Ther. Drug Carrier Syst.*, 5(1):1-20 (1988).

Craig et. al., Sclerostin binds and regulates the activity of cysteine rich protein 61. *Biochem. Biophys. Res. Commun.*, 293(1): 36-40 (2010).

Craig et. al., Sclerostin-erbB-3 interactions: Modulation of erbB-3 activity by sclerostin. *Biochem. Biophys. Res. Commun.*, 402: 421-4 (2010).

Crameri et. al., DNA shuffling of a family of genes from diverse species accelerates directed evolution. *Nature*, 391:288-91 (1998).

Dall'Acqua et. al., Antibody humanization by framework shuffling. *Methods*, 36(1):43-60 (2005).

Davies, et. al., Affinity improvement of single antibody VH domains: Residues in all three hypervariable regions affect antigen binding. *Immunotechnology*, 2(3): 169-79 (1996).

de Jong et. al., Evolution of the α-crystallin/small heat-shock protein family. *Mol. Biol. Evol.*, 10(1): 103-26 (1993).

Dean et. al., Matrix vesicles produced by osteoblast-like cells in culture become significantly enriched in proteoglycan-degrading metalloproteinases after addition of β-glycerophosphate and ascorbic acid. *Calcif. Tissue*, 54: 399-408 (1994).

Declaration filed in connection with the European Patent EP 1133558 Opposition, Expert opinion of Dr. Auristela Freire de Paes Alves, Ph.D., dated Sep. 9, 2009.

Declaration filed in connection with the European Patent EP 1133558 Opposition, Expert opinion of Dr. Walter Sebald, dated Sep. 24, 2009.

Declaration filed in connection with the European Patent EP 1133558 Opposition, Expert opinion of Prof. Dr. Edgar Wingender, dated Sep. 24, 2009.

Declaration filed in connection with the European Patent EP 1133558 Opposition, Expert opinion of Prof. Dr. Thomas Muller, dated Sep. 23, 2009.

Declaration of Alistair J. Henry, citation in Appeal, European Patent No. 1133558, dated Apr. 2, 2010.

Declaration of Dr. Martyn Robinson, submitted in Opposition to European Patent No. 1133558, dated Jan. 13, 2008.

Declaration of Dr. Mary E. Brunkow, submitted in Opposition to European Patent No. 1133558, dated Jan. 9, 2008.

Declaration of Dr. Raymond Dalgleish dated Dec. 8, 2011, citation in Appeal, European Patent No. 1133558.

Declaration of Prof. Edgar Wingender filed in connection with that Opposition regarding European Patent EP 1133558 B1, dated Mar. 10, 2011.

Declaration of Professor Teresa Attwood, citation in Appeal, European Patent No. 1133558, dated Apr. 13, 2010.

Declaration of Tim Arnett, citation in Appeal, European Patent No. 1133558, dated Apr. 2, 2010.

Delmas et. al., The use of biochemical markers of bone turnover in osteoporosis. *Osteoporosis International*, Suppl. 6:S2-17 (2000).

Diagram of the candidate interval, citation by Propriator in Opposition against European Patent No. 1721979 on Feb. 20, 2012.

Ducy et. al., 5-HT and bone biology. *Curr. Opin. Pharmacol.*, 11: 34-8 (2011).

Ducy et. al., Genetic control of cell differentiation in the skeleton. *Curr. Opin. Cell Biol.*, 10: 614-9 (1998).

Durham et. al., Alterations in insulin-like growth factor (IGF)-dependent IGF-binding protein-4 proteolysis in transformed osteoblastic cells. *Endocrinology*, 136(4):1374-80 (1995).

Ebara et. al., Mechanism for the action of bone morphogenetic proteins and regulation of their activity. *Spine*, 27(165):S10-5 (2002).

Eli Lilly Statement of Grounds of Appeal, Opposition to European Patent Application No. 1133558 B1, dated Sep. 28, 2009.

Eli Lilly, Biacore experiment comparison results, Setup assay to measure BMP binding to captured SOST, referenced on p. 41 of reference C193, dated Sep. 28, 2009.

Epstein et. al., Endocrine function in sclerosteosis. *S. Afr. Med. J.*, 55:1105-10 (1979).

Ettenberg et al., Inhibition of tumorigenesis driven by different Wnt proteins requires blockade of distinct ligand-binding regions by LRP6 antibodies. *Proc. Natl. Acad. Sci. USA*, 107:15473 (2010).

European Patent Office Communication, Opposition to European Patent No. 1133558, dated Nov. 4, 2008.

European Patent Office, "Opinion of the Enlarged Board of Appeal dated Dec. 1992 G1/92", available from [http://documents.epo.org/projects/babylon/eponet.nsf/0/907016FA57B46FD0C12572C8006CD2E2/$File/g920001.pdf], cited Jun. 15, 2011.

Expert Opinion from Dr. Catalina Lopez-Correa, submitted in Opposition to European Patent No. 1133558, dated Mar. 6, 2009.

Expert opinion of Professor Dr.-Ing Ulrich Vollrath, citation in Appeal of European Patent No. 1133558, dated Apr. 12, 2005.

Extract from Sigma Aldrich catalogue, cited in Opposition against European Patent No. 1721979 by Opponent: Laudens, dated Jun. 15, 2011.

Eyre et. al., Characterization of aromatase and 17β-hydroxysteroid dehydrogenase expression in rat osteoblastic cells. *J. Bone Miner. Res.*, 13(6): 996-1004 (1998).

Foster et. al., Establishment of interference in osteoblasts by an osteopetrosis-inducing Avian Leukosis virus. *Virology*, 205: 376-8 (1994).

Fouser et. al., Feedback regulation of collagen gene expression: A Trojan horse approach. *Proc. Natl. Acad. Sci. USA*, 88: 10158-62 (1991).

Frost et. al., On the rat model of human osteopenias and osteoporoses. *Bone and Mineral*, 18:227-36 (1992).

Fujiwara et. al., GenBank Sequence Database Accession No. D79813, Feb. 9, 1996.

Gardner et. al., Bone mineral density in sclerosteosis; Affected individuals and gene carriers. *J. Clin. Endocrinol. Metab.*, 90(12): 6392-5 (2005).

Gavarini et. al., Opposite effects of PSD-95 and MPP3 PDZ proteins on serotonin 5-hydroxytryptamine2C receptor desensitization and membrane stability. *Molec. Biol.*, 17: 4619-31 (2006).

Gavriatolpoulou et al., Dickkopf-1: a suitable target for the management of myeloma bone disease. *Expert Opin. Ther. Targets*, 13(7):839-48 (2009).

Gazzerro et. al., Bone morphogenetic proteins induce the expression of noggin which limits their activity in cultured rat osteoblasts. *J. Clin. Invest.*, 102(12):2106-14 (1998).

Gazzerro et. al., Potential drug targets within bone morphogenetic protein signaling pathways. *Curr. Opin. Pharmacol.*, 7: 325-3 (2007).

Geissler et la., Male pseudohermaphroditism caused by mutations of testicular 17β-hydroxysteroid hehydrogenase 3. *Nat. Genetics*, 7: 34-9 (1994).

(56) References Cited

OTHER PUBLICATIONS

Gencic et. al., Conservative amino acid substitution in the myelin proteolipid protein of Jimpymsd mice. *J. Neurosci.*, 10(1):117-24 (1990).

Geysen et. al., Cognitive features of continuous antigenic determinants. *J. Molec. Recog.*, 1(1):32-41 (1988).

Gitelman et. al., Vgr-1/BMP-6 induces osteoblastic differentiation of pluripotential mesenchymal cells. *Cell Growth & Differentiation*, 6:827-36 (1995).

Glasky et. al., Stability of specific immunoglobulin secretion by EBV-transformed lymphoblastoid cells and human-murine heterohybridomas. *Hybridoma*, 8:377-89 (1989).

Gowen et. al., Actions of recombinant human γ-interferon and tumor necrosis factor α on the proliferation and osteoblastic characteristics of human trabecular bone cells in vitro. *Arthritis Rheumatism*, 31(12): 1500-7 (1988).

Graner et. al., Splice variants of the *Drosophila* PS2 integrins differentially interact with RGD-containing fragments of the extracellular proteins tiggrin, Ten-m and D-laminin α2. *J. Biol. Chem.*, 273(29): 18235-41 (1998).

Green et al., Cytosolic pH regulation in osteoblasts. *J. Gen. Physiol.*, 95: 121-45 (1990).

Green et. al., Antigen-specific human monoclonal antibodies from mice engineered with human Ig heavy and light chain YACs. *Nat. Genet.*, 7:13 (1994).

Greene et. al., Screening Recombinant DNA Libraries. *Current Protocols in Molecular Biology*, Ch. 6(1) (1990).

Gribskov et. al., Profile analysis. *Meth. Enzym.*, 183:146-59 (1990).

Gribskov et. al., Profile analysis: Detection of distantly related proteins. *Proc. Nat. Acad. Sci. USA*, 84(13):4355-8 (1987).

Groeneveld et. al., Bone morphogenetic proteins in human bone regeneration. *Eur. J. Endocrinol.*, 142:9-21 (2000).

Gronthos et. al., Integrin expression and function on human osteoblast-like cells. *J. Bone Miner. Res.*, 12(8): 1189-97 (1997).

Groppe et. al., Structural basis of BMP signalling inhibition by the cystine knot protein noggin. *Nature*, 420:636-42 (2002).

Guinness-Hey, Increased trabecular bone mass in rats treated with human synthetic parathyroid hormone. *Metab. Bone Dis. Relat. Res.*, 5:177-81 (1984).

Halleen et al., Tartrate-resistant acid phosphatase 5b (TRACP 5b) as a marker of bone resorption. *Clin. Lab.*, 52:499-509 (2006).

Harlow et. al., Antibodies: A Laboratory Manual, Cold Spring Harbor Laboratory, 141-157 (1988).

Harris, Processing of C-terminal lysine and arginine residues of proteins isolated from mammalian cell culture. *J. Chromatogr.*, 705:129-34 (1995).

Hart et. al., Crystal structure of the human TβR2 ectodomain-TGF-β3 complex. *Nat. Struc. Biol.*, 9(3):203-8 (2002).

Hay et. al., ATCC Cell Line and Hybridomas, American Type Culture Collection, 8th Ed., pp. 149, 258, 428 (1994).

He et. al., High-throughput dynamic light scattering method for measuring viscosity of concentrated protein solutions. *Anal. Biochem.*, 399(1): 141-3 (2010).

Heinecke et. al., Receptor oligomerization and beyond: A case study in bone morphogenetic proteins, *BMC Biol.*, 7: 59 (2009).

Hill et. al., Multiple extracellular signals promote osteoblast survival and apoptosis. *Endocrinology*, 138(9):3849-58 (1997).

Hillier et. al., EMBL Sequence Database Accession No. AA393939, May 19, 1997.

Hillier et. al., GenBank Sequence Database Accession No. AA393768, Apr. 24, 1997.

Hillier et. al., Generation and analysis of 280,000 human expressed sequence tags. *Genome Res.*, 6: 807-28 (1996).

Hilliker et. al., Truncation of the amino terminus of PTH alters its anabolic activity on bone in vivo. *Bone*, 19(5): 469-77 (1996).

Hirschhorn, Letter to the editor: Dominance and homozygosity in man. *Am. J. Med. Genetics*, 18: 541 (1984).

Hock et. al., Perspective: Osteoblast apoptosis and bone turnover. *J. Bone Miner. Res.*, 16(6):975-84 (2001).

Hoffman et. al., BMP Signaling Pathways in Cartilage and Bone Formation. *Crit. Rev. Eukaryotic Gene Exp.*, 11(1-3):23-45 (2001).

Hoggard et. al., Localization of leptin receptor mRNA splice variants in murine peripheral tissues by RT-PCR and in situ hybridization. *Biochem. Biophys. Res. Commun.*, 232: 383-7 (1997).

Hollinger et. al., Engineered antibody fragments and the rise of single domains. *Nat. Biotech.*, 23(9):1126-36 (2005).

Holm et. al., Protein folds and families: Sequence and structure alignments. *Nucl. Acid Res.*, 27(1):244-7 (1999).

Holt, et. al., Domain antibodies: Proteins for therapy. *Trends Biotechnol.*, 21(11):484-90 (2003).

Hoogenboom et. al., By-passing immunisation: Human antibodies from synthetic repertoires of germline VH gene segmens rearranged in vitro. *J. Molec. Biol.*, 227:381-8 (1992).

Hoogewerf et. al., Glycosaminoglycans mediate cell surface oligomerization of chemokines. *Biochemistry*, 36: 13570-8 (1997).

Horton et. al., Arg-Gly-Asp (RGD) peptides and the anti-vitronectin receptor antibody 23C6 inhibit dentine resorption and cell spreading by osteoclasts. *Exp. Cell Res.*, 195: 368-75 (1991).

Hsu et. al.,The Xenopus dorsalizing factor gremlin indentified a novel family of secreted proteins that antagonize BMP activities. *Molec. Cell*, 1:673-83 (1998).

Hufner et. al., Evidence for an osteoblast-activating factor in a patient with peripheral T-cell lymphoma and osteosclerosis. *Klin. Wochenscher.*, 67: 402-7 (1989).

Hulley et. al., Inhibition of mitogen-activated protein kinase activity and proliferation of an early osteoblast cell line (MBA 15.4) by dexamethasone: Role of protein phosphatases. *Endocrinol.*, 139(5):2423-31 (1998).

Huse et. al., Generation of a large combinatorial library of the immunoglobulin repertoire in phage lambda. *Science*, 246:1275-81 (1989).

Hwang et. al., Use of human germline genes in a CDR homoloy-based approach to antibody humanization. *Methods*, 36(1):35-42 (2005).

Ide et. al., GenBank Sequence Database Accession No. BAA19765, Feb. 7, 1999.

Ide et. al., GenBank Sequence Datacase Accession No. D89675, Feb. 7, 1999.

Iemura et. al., Direct binding of follistatin to a complex of bone-morphogenetic protein and its receptor inhibits ventral and epidermal cell fates in early Xenopus embryo. *Proc. Natl. Acad. Sci. USA*, 95:9337-42 (1998).

Innis et. al., Evolutionary trace analysis of TGF-B and related growth factors: Implications for stie-directed mutagenesis. *Protein Engineering*, 13(12):839-47 (2000).

Jakobovits et. al., Production of antigen-specific human antibodies from mice engineered with human heavy and light chain YACsa. *Ann. N.Y. Acad. Sci.*, 764:525-35 (1995).

Jee et. al., Overview: Animal models of osteopenia and osteoporosis. *J. Musculoskel. Neuron. Interact.*, 1:193-207 (2001).

Jilka et. al., Increased bone formation by prevention of osteoblast apoptosis with parathyroid hormone. *J. Clin. Invest.*, 104:439-46 (1999).

Jilka et. al., Osteoblast programmed cell death (apoptosis): Modulation by growth factors and cytokines. *J. Bone Miner. Res.*, 13(5): 793-802 (1998).

Jones, Progress in protein structure predication. *Curr. Opin. Struct. Biol.*, 7(3):377-387 (1997).

Kabat et. al., Sequences of proteins of immunological interest, U.S. Department of Health and Human Services, *NIH, USA* (1987) (Table of Contents).

Kalu, The ovariectomized rat model of postmenopausal bone loss. *Bone and Mineral*, 15:175-92 (1991).

Kang et. al., Linkage of recognition and replication functions by assembling combinatorial antibody Fab libraries along phage surfaces. *Proc. Natl. Acad. Sci. USA*, 88:4363-6 (1991).

Katagiri et. al., The non-osteogenic mouse pluripotent cell line, C3H10T1/2, is induced to differentiate into osteoblastic cells by recombinant human bone morphogenetic protein-2. *Biochem. Biophys. Res. Comm.*, 172(1):295-9 (1990).

Kawabata et. al., Signal transduction by bone morphogenetic proteins. *Cytokine and Growth Factor Reviews*, 9(1):49-61 (1998).

(56) References Cited

OTHER PUBLICATIONS

Keller et. al., Molecular recognition of BMP-2 and BMP receptor IA. *Nat. Struct. Mol. Biol.*, 11 (5):481-488 (2004).
Khalil, TGF-β: From latent to active. *Microbes and Infection*, 1(15):1255-63 (1999).
Khosla et. al., Concise review for primary-care physicians. Treatment pptions for osteoporosis. *Mayo Clin. Proc.*, 70:978-82 (1995).
Kirsch et. al., BMP-2 antagonists emerge from alterations in the low-affinity binding epitope for receptor BMPR-II, *EMBO J.*, 19(13): 3314-24 (2000).
Kohler et. al., Continuous cultures of fused cells secreting antibody of predefined specificity. *Nature*, 256:495 (1975).
Koli et. al., Latency, activation, and binding proteins of TGF-. *Microscopy Res. Tech.*, 52:354-62 (2001).
Komatsu et al., Modulation of Wnt signaling influences fracture repair. *J. Orthop. Res.*, 28(7):928-36 (2010).
Koreth et. al., Microsatellites and PCR genomic analysis. *J. Pathology*, 178:239-48 (1996).
Kramer et. al., The gapped duplex DNA approach to oligonucleotide-directed mutation construction. *Nuc. Acids Res.*, 12:9441 (1984).
Krause et. al., Distinct modes of inhibition by sclerostin on bone morphogenetic protein and Wnt signaling pathways. *J. Biol. Chem.*, 285(53): 41614-26 (2010).
Krupnik et al., Functional and structural diversity of the human Dickkopf gene family. *Gene*, 238: 301-13 (1999).
Kunkel et. al., Rapid and efficient site-specific mutagenesis without phenoypic selection. *Meth. Enzymol.*, 154:367-82 (1987).
Kunkel, Rapid and efficient site-specific mutagenesis without phenotypic selection. *Proc. Natl. Acad. Sci. USA*, 82:488-92 (1985).
Kurahashi et. al., Regions of genomic instability on 22q11 and 11 q23 as the etiology for the recurrent constitutional t (11;22). *Hum. Molec. Genet.*, 9: 1665-70 (2000).
Kusu et. al., Sclerostin is a novel secreted osteoclast-dervied bone morphogenetic protein antagonist with unique ligand specificity. *J. Biol. Chem.*, 278:24113-7 (2003).
Labat et. al., Retroviral expression in mononuclear blood cells isolated from a patient with osteopetrosis (Albers-Schonberg disease). *J. Bone Miner. Res.*, 5(5): 425-35 (1989).
Labat, A new approach to the study of the origin of genetic disease: Retroviral etiology of osteopetrosis. *Biomed. Pharmacother.*, 45: 23-7 (1991).
Lasic, Novel applications of liposomes. *Trends Biotechnol.*, 16(7):307-21 (1998).
Latham, The biochemical and cellular characterization of sclerostin, the causative gene for sclerostenosis. *Calcified Tissue International*, 70(4):244 (2002).
Leppert et. al., Benign familial neonatal epilepsy with mutations in two potassium channel genes. *Curr. Opin. Neurol.*, 12: 143-7 (1999).
Lewiecki et. al., Sclerostin monoclonal antibody therapy with AMG 785: A potential treatment for osteoporosis. *Exp. Opin. Biol. Ther.*, 11(1): 117-27 (2011).
Li et. al., Sclerostin binds to LRP5/6 and antagonizes canonical Wnt signaling. *J. Biol.Chem.*, 280: 19883-7 (2005).
Li et. al., Treatment with an anti-sclerostin antibody directly stimulates bone formation in a dose-dependent manner in ovariectomized rats with established osteopenia. *J. Bone Min. Res.*, 22(Suppl. S1): S65 (2007).
Lian et. al., Bone Formation: Osteoblast Lineage Cells, Growth Factors, Matrix Proteins, and the Mineralization Process, Primer on the Metabolic Bone Diseases and Disorders of Mineral Metabolism, 4th Edition, 14-29 (1999).
Lierop et. al., Van Buchem disease: Clinical, biochemical and densitometric features of patients and disease carriers. *J. Bone Miner. Res. Accepted Article* (2012).
Liu et. al., GenBank Sequence Database Accession No. U25110, Feb. 2, 1996.
Liu et. al., Human type II receptor for bone morphogenic proteins (BMPs): Extension of the two-kinase receptor model to the BMPs. *Molec. Cell. Biol.*, 15(7):3479-86 (1995).
Lonberg et. al., Antigen-specific human antibodies from mice comprising four distinct genetic modifications. *Nature*, 368:856 (1994).
Loots et. al., Genomic deletion of a long-range bone enhancer misregulates sclerostin in Van Buchem disease. *Genome Res.*, 15: 928-35 (2005).
Low et. al., Mimicking somatic hypermutation: Affinity maturation of antibodies displayed on bacteriophage using a bacterial mutator strain. *J. Mol. Biol.*, 250:350-68 (1996).
Lowik et. al., Wnt signaling is involved in the inhibitory action of sclerostin on BMP-stimulated bone formation. *J. Musculoskeleton Neuronal Interact.*, 6: 357 (2006).
Luckman et. al., Heterocycle-containing bisphosphonates cause apoptosis and inhibit bone resorption by preventing protein prenylation: Evidence from structure-activity relationships in J774 macrophages. *J. Bone Miner. Res.*, 13(11): 1668-78 (1998).
Luckman et. al., Nitrogen-containing bisphosphonates inhibit the mevalonate pathway and prevent post-translational prenylation of GTP-binding proteins, including Ras. *J. Bone Miner. Res.*, 13(4): 581-9 (1998).
Mack et al, A small bispecific antibody construct expressed as a functional single-chain molecule with high tumor cell cytotoxicity. *Proc. Natl. Acad. Sci. USA*, 92(15): 7021-5 (1995).
Malone et. al., Bone anabolism achieved by reducing sclerostin bioavailability with an anti-sclerostin antibody. 37th International Sun Valley Workshop on Skeletal Tissue Biology. Aug. 5-8, 2007.
Mango et. al., Carboxy-terminal truncation activates glp-1 protein to specify vulval fates in Caenorhabditis elegans. *Lett. Nature*, 352: 811-15 (1991).
Margalit et. al., Comparative analysis of structurally defined herparin binding sequences reveals a distinct spatial distribution of basic residues. *J. Biol. Chem.*, 268 (26): 19228-31 (1993).
Margalit, Liposome-mediated drug targeting in topical and regional therapies. *Crit. Rev. Ther. Drug Carrier Syst.*, 12(2-3):233-61 (1995).
Marks et. al., By-passing immunization: Building high affinity human antibodies by chain shuffling. *Bio/Technology*, 10:779-83 (1992).
Matthews et. al., Adenovirus protein-protein interactions: Hexon and protein VI. *J. Gen. Virol.*, 75: 3365-74 (1994).
Mayer et. al., Differentiation of osteogenetic cells: Systems and regulators, Z. Orthop., 130: 276-84 (1992)—Abstract Only.
McClung et. al., Inhibition of sclerostin with AMG 785 in postmenopausal women with low bone mineral density: Phase 2 trial results—Abstract presented at the 2012 meeting of the American Society for Bone and Mineral Reasearch (2012).
Memorandum C, Munich Diplomatic Conference, Sep. 1 to Oct. 6, 1973.
Minabe-Saegusa et. al., Genbank Sequence Database Accession No. AB011030, Jun. 23, 1998.
Minutes of the oral proceedings before the opposition division for Opposition against European Patent No. 1721979, dated May 10, 2013.
Miyazono et. al., Divergence and convergence of TGF-β/BMP signaling. *J. Cell. Physiol.*, 187:265-76 (2001).
Miyazono et. al., TGF-β signaling by Smad proteins. *Adv. Immunology*, 75:115-57 (2000).
Morais et. al., In vitro biomineralization by osteoblast-like cells I. Retardation of tissue mineralization by metal salts. *Biomaterials*, 19: 13-21 (1998).
Mori et. al., A novel amino acid substitution a the receptor-binding site on the hemaglutinin of H3N2 influenza A viruses isolated from 6 cases with acute encephalopathy during 1997-1998 season in Tokyo. *Arch. Virol.*, 144: 147-55 (1999).
Morrison et. al., ATP is a potent stimulator of the activiation and formation of rodent osteoclasts. *J. Physiol.*, 511.2: 495-500 (1998).
Mosekilde et. al., Assessing bone quality—Animcal models in preclinincal osteoporosis research. *Bone*, 17 (4): 343S-52S (1995).
Moult, The current state of the art in protein structure predicion. *Curr. Opin. Biotech.*, 7(4):422-7 (1996).

(56) References Cited

OTHER PUBLICATIONS

Mullins et. al., Perspectives series: Molecular medicine in genetically engineered animals; Transgenesis in the rat and larger mammals. *J. Clin. Invest.*, 97(7):1557-60 (1996).
Muntoni et. al., A mutation in the dystrophin gene selectively affecting dystrophin expression in the heart. *J. Clin. Invest.*, 96: 693-9 (1995).
Nagaraja et. al., X chromosome map at 75-kb STS resolution, revealing extremes of recombination and GC content. *Genome Res.*, 7: 210-22 (1997).
Nakase et. al., Transient and localized expression of bone morphogenetic protein 4 messenger RNA during fracture healing. *J. Bone Miner. Res.*, 9(5):651-9 (1994).
Nelson, Positional cloning reaches maturity. *Curr. Opin. Genet. Devel.*, 5:298-303 (1995).
Nickel et. al., The crystal structure of the BMP-2: BMPR-1A complex and the generation of BMP-2 antagonists. *J. Bone Joint Surg.*, 83-A:S1-7-S1-14 (2001).
Nicolas et. al., An age-related decrease in the concentration of insulin-like growth factor binding protein-5 in human cortical bone. *Calcif. Tissue Int.*, 57:206-12 (1995).
Nifuji et. al., Coordinated expression of noggin and bone morphogenetic proteins (BMPs) during early skeletogenesi and induction of noggin expression by BMP-7. *J. Bone Miner. Res.*, 14(12):2057-66 (1999).
Nisonoff et. al., Separation of univalent fragments from the bivalent rabbit antidody molecule by reduction of disulfide bonds. *Arch. Biochem. Biophys.*, 89:230-44 (1960).
Niu et. al., Sclerostin inhibition leads to increased periosteal and endocortical bone formation as well as decreased cortical porosity in aged ovariectomized rats. *J. Bone Min. Res.*, 22(Suppl. S1) S65 (2007).
Nordsletten et. al., The neuronal regulation of fracture healing. *Acta Orthop Scand.*, 65(3): 299-304 (1994 ).
Notice of Opposition against European Patent. No. 1133558, Opponent: Eli Lilly and Company, dated May 31, 2007.
Notice of Opposition against European Patent No. 1721979, Opponent: Eli Lilly & Company, dated Jun. 15, 2011.
Notice of Opposition against European Patent No. 1721979, Opponent: Laudens, dated Jun. 15, 2011.
Notice of Opposition against European Patent No. 1721979, Opponent: Novartis Ag, dated Jun. 15, 2011.
Notice of Opposition to European Patent No. 1 133 558, dated May 29, 2007.
Nygren et. al., Scaffolds for engineering novel binding sites in proteins. *Curr. Opin. Struct. Biol.*, 7:463-9 (1997).
Observations of Opponent: Laudens in response to summons to oral proceedings in Opposition against European Patent No. 1721979, dated Feb. 25, 2013.
Oelgeschlager et. al., The evolutionarily conserved BMP-binding protein twisted gastrulation promotes BMP signalling. *Nature*, 405:757-63 (2000).
OMIM #607625, Niemann-pick disease, type C2 (2007).
Ominsky, et. al., Sclerostin monoclonal antibody treatment increases bone strength in aged osteopenic ovariectomozed rats. *J. Bone Min. Res.*, 21(1): S44 PRES1161 (2006). Abstract.
Opposition Decision for Opposition against European Patent No. 1721979, dated Aug. 2, 2013.
Opposition Statement of May 20, 2007 filed by Opponent 2 (Eli Lilly) against European Patent No. 1133558.
Oreffo et. al., Human bone marrow osteoprogenitors express estrogen receptor-alpha and bone morphogenetic proteins 2 and 4 mRNA during osteoblastic differentiation. *J Cell. Biochem.*, 75:382-92 (1999).
Orriss et al., Purinergic signaling and bone remodeling. *Curr. Opin. Pharmacol.*, 10:322-30 (2010).
Oshima et. al., TGF-β receeoptor type II deficiency results in defects of yolk Sac hematopoiesis and vasculogenesis. *Dev. Biol.*, 179:297-302 (1996).

Padhi et al., Single-dose, placebo-controlled, randomized study of AMG 785, a sclerostin monoclonal antibody. *J. Bone Miner. Res.*, 19-26 (2011).
Padhi et. al., Anti-sclerostin antibody increases markers of bone formation in healthy postmenopausal women. *J. Bone Min. Res.*, 22: S37 (2007).
Padhi et. al., OC35—Effects of anti-sclerostin monoclonal antibody in healthy postmenopausal women. *Osteoporosis Int.*, 19: Suppl. 1: S19 (2008).
Padlan et. al., Structure of an antibody-antigen complex; Crystal structure of the HyHEL-10 Feb-lysozyme complex. *Proc. Natl. Acad. Sci. USA*, 86:5938-42 (1989).
Palokangas et. al., Endocytic pathway from the basal plasma membrane to the ruffled border membrane in bone-resorbing osteoclasts. *J. Cell Sci.*, 110: 1767-80 (1997).
Pandey et. al., Nucleotide sequence database: A gold mine for biologists. *TIBS.*, 24: 276-80 (1999).
Papapoulos et. al., Targeting sclerostin as potential treatment of osteoporosis. *Ann. Rheum. Dis.*, 70(Suppl. 1): I119-22 (2011).
Patel et al., Regulation of bone formation and vision by LRP5. *N. Eng. J. Med.*, 346:1572-3 (2002).
Patel et. al., Current and potential future drug treatments for osteoporosis. *Ann. Rheumatic Dis.*, 55: 700-14 (1996).
Patten et. al., Applications of DNA shuffling to pharmaceuticals and vaccines. *Curr. Opin. Biotechnol.*, 8:724-33 (1997).
Pearson et. al., Effective protein sequence comparison. Chapter 15, pp. 227-258 (1996).
Piao et. al., The proximal promotor region of the gene encoding human 17β-hydroxysteroid dehydrogenase type 1 contains GATA, AP-2, and Sp1 response elements: Analysis of promotor function in choriocarcinoma cells. *Endrocrinol.*, 138(8): 3417-25 (1997).
Piccolo et. al., The head inducer Cerberus is a multifunctional antagonist of nodal, BMP and Wnt signals. *Nature*, 397: 707-10 (1999).
Piek et. al., Specificity, diversity, and regulation of TGF-β superfamily signaling. *FASEB J.*, 13:2105-24 (1999).
Pietromonaco et. al., Protein kinase C-Θ phosphorylation of moesin in the actin-binding sequence. *J. Biol. Chem.*, 273:7594-603 (1998).
Pignatti et. al., Tracking disease genes by reverse genetics. *J. Psychiar. Res.*, 26(4):287-98 (1992).
Pittenger et. al., Multilineage potential of adult human mesenchymal stem cells. *Science*, 284:143-7 (1999).
Pluckthun et. al., Expression of functional anitbody Fv and Fab fragments in *Escherichia coli*. *Meth. Enzymol.*, 178:497-515 (1989).
Pockwinse et. al., Expression of cell growth and bone specific genes at single cell resolution during development of bone tissue-like organization in primary osteoblast cultures. *J. Cell. Biol.*, 49:310-23 (1992).
Poole et. al., Sclerostin is a delayed secreted product of osteocytes that inhibit bone formation. *FESEB J.*, 19: 1842-4 (2005).
Porter, The hydrolysis of rabbit γ-globulin and antibodies with crystalline papain. *Biochem. J.*, 73:119-26 (1959).
Proprietor's Response to Opponent's Statement of Grounds of Appeal, European Patent No. 1133558, dated Apr. 15, 2010.
Proprietor's Response to Oppositions against European Patent No. 1721979, UCB Pharma S.A., dated Feb. 20, 2012.
Proprietor's Written submission in preparation for oral proceedings in Opposition against European Patent No. 1721979, Proprietor: UCB Pharma S.A., dated Feb. 25, 2013.
Quintanar-Guerrero et. al., Preparation techniques and mechanisms of formation of biodegradable nanoparticles from preformed polymers. *Drug Dev. Ind. Pharm.*, 24(12):1113-28 (1998).
Rachner et. al., Osteoporosis: Now and the future. *Lancet*, 377(9773): 1276-87 (2011).
Rawadi et. al., BMP-2 controls alkaline phosphatase expression and osteoblast mineralization by a Wnt autocrine loop. *J. Bone Min. Res.*, 18: 1842-53 (2003).
Reb, Antikorpergegen sclerostin, *Medical Tribune*, 39:12 (2007).
Reddi et. al., The *Escherichia coli* chaperonin 60 (groEL) is a potent stimulator of osteoclast formation. *J. Bone Miner. Res.*, 13(8): 1260-6 (1998).

(56) References Cited

OTHER PUBLICATIONS

Reddi, Interplay between bone morphogenetic proteins and cognate binding proteins in bone and cartilage development: Noggin, chordin and DAN. *Arthritis Res.*, 3(1):1-5 (2000).
Response to Proprietor's brief of Apr. 15, 2010, European Patent Opposition, EP-1133558 B1, dated Mar. 18, 2011.
Riggs, Overview of osteoporosis. *West J. Med.*, 154:63-77 (1991).
RnD Systems catalogue excerpt, cited in Opposition against European Patent No. 1721979 by Opponent: Novartis AG dated Jun. 15, 2011.
Roberts et. al., Essential functional interactions of SAFA, a *Saccharomyces cerevisiae* complex of Spt, Ada, and Gcn5 proteins, with the Snf/Swi and Srb/Mediator complexes. *Genetics*, 147: 451-65 (1997).
Robinson et. al., The sclerostin antibody project. *Hum. Antibodies*, 16:36 (2007).
Roitt et la., Roitt's Essential Immunology, 9th Edition, pp. 90-91 (1997).
Rosenzweig et. al., Cloning and characterization of a human type II receptor for bone morphogenetic proteins. *Proc. Natl. Acad. Sci. USA*, 92:7632-7636 (1995).
Rosenzweig et. al., GenBank Sequence Database Accession No. CAA88759, Oct. 7, 2008.
Rosenzweig et. al., GenBank Sequence Database Accession No. Z48923, Oct. 7, 2008.
Rudikoff, et. al., Single amino acid substitution altering antigen-binding specificity. *Proc. Natl. Acad. Sci. USA*, 79:1979-83 (1982).
Ruppert et. al., Human bone morphogenetic protein 2 contains a heparin-binding site which modifies its biological activity. *Eur. J. Biochem.*, 237: 295-302 (1996).
Sada et. al., Adsorption equilibirum in immuno-affinity chromatography with polyclonal and monoclonal antibodies. *Biotechnol. Bioengin.*, 28 (1986). Abstract.
Sali et. al., Comparative protein modeling by satisfaction of spatial restraints. *J. Mol. Biol.*, 234(3):779-815 (1993).
Sambrook et. al., Synthetic oligonucleotide probes, molecular cloning—A Laboratory Manual, Ch.11:11.1-11.19 and 11.58-11.61 (1989).
Sanger et. al., DNA sequencing with chain-terminating inhibitors. *Proc. Natl. Acad. Sci. USA*, 74:5463-7 (1997).
Sastry et. al., Cloning of the immunological repertoire in *Escherichia coli* for generation of monoclonal catalytic antibodies: Construction of a heavy chain variable region-specific cDNA library. *Proc. Natl. Acad. Sci. USA*, 86:5728-32 (1989).
Scatchard et. al., The attractions of proteins for small molecules and ions. *Ann. N. Y. Acad. Sci.*, 51:660-72 (1949).
Schaefer et al., Immunoglobulin domain crossover as a generic approach for the production of bispecific IgG antibodies. *Proc. Natl. Acad. Sci. USA*, 108(27):11187-92 (2011).
Scheufler et. al., Crystal structure of human bone morphogenetic protein-2 at 2.7 A resolution. *J. Mol. Biol.*, 287(1)1 01-15 (1999).
Schlebusch et. al., Production of a single-chain fragment of the murine anti-idiotypic antibody ACA125 as phage-displayed and soluble antibody by recombinant phage antibody technique. *Hybridoma*, 16:47-52 (1997).
Schlunegger et. al., Refined crystal structure of human transforming growth factor β2 at 1.95 A Resolution. *J. Mol. Biol.*, 231(2):445-458 (1993).
Schmidt et. al., Retrovirus-induced osteopetrosis in mice: Effects of viral infection on osteogenic differentiation in skeletoblast cell cultures. *Am. J. Pathol.*, 129(3): 503-10 (1987).
Schmitt et. al., Bone morphogenetic proteins: An update on basic biology and clinical relevance. *J. Orth. Res.*, 17:269-78 (1999).
Schwappacher et. al., NCBI Sequence Database Accession No. NM_001204, Aug. 16, 2009.
Scotti t al., Additive effects of a prolactin receptor antagonist, G129R, and herceptin on inhibition of HER2-overexpressing breast cancer cells. *Breast Cancer Res. Treat.*, 111 (2):241-50 (2008).
Scully et. al., BRCA1 is a component of the RNA polymerase II holoenzyme. *Proc. Natl. Acad. Sci. USA*, 94: 5605-10 (1997).
Second declaration of Martyn Robinson, citation in Appeal, European Patent No. 1133558, dated Apr. 15, 2010.
Serra et. al., Expression of a truncated, kinase-defective TGF-β type II receeptor in mouse skeletal tissue promotes terminal chondrocyte differentiation and osteoarthritis. *J. Cell. Biol.*, 139(2):541-52 (1997).
Sigmund, Viewpoint: Are studies in genetically altered mice out of control? *Arterioscler. Thromb. Vasc. Biol.*, 20:1425-9 (2000).
Silverman et. al., Sclerostin, *J. Osteoporosis*, 2010: 1-3 (2010).
Sippl et. al., Threading thrills and threats. *Structure*, 4(1):15-19 (1996).
Siris, Clinical Review: Paget's disease of bone. *J. Bone Miner. Res.*, 13(7): 1061-5 (1998).
Sivakumar et. al., New insights into extracellular matrix assembly and reorganization from dynamic imaging of extracellular matrix proteins in living osteoblasts. *J. Cell. Sci.*, 119(7):1350-60 (2006).
Skiple Skjerpen et. al., Binding of FGF-1 variants to protein kinase CK2 correlates with mitogenicity. *EMBO J.*, 21(15): 4058-69 (2002).
Slater et. al., Involvement of platelets in stimulating osteogenic activity. *J. Orthopaedic Res.*, 13: 655-63 (1995).
Smith et. al., Glucocorticoids inhibit development stage-specific osteoblast cell cycle. *J. Biol. Chem.*, 275:19992-20001 (2000).
Smith, TGF β inhibitors, new and unexpected requirements in vertebrate development. *TIG*, 15(1):3-5 (1999).
Sohocki et. al., a range of clinical phenotypes associated with mutations in CRX, a photoreceptor transcription-factor gene. *Am. J. Hum. Genet.*, 63: 1307-15 (1998).
Spranger, International classification of osteochondrodysplasias, *Eur. J. Pediatr.*, 151: 407-15 (1992).
Staehling-Hampton et. al., A 52-kb deletion in the SOST-MEOX1 intergenic region on 17q12-q21 is associated with van Buchem disease in the Dutch population. *Am. J. Med. Gen.*, 110:144-52 (2002).
Stanley et. al., DAN is a secreted glycopeotein related to Xenopus cerberus. *Mech. Dev.*, 77:173-84 (1998).
Statement of Grounds of Appeal to Decision of Opposition against European Patent No. 1133558, dated Sep. 28, 2009.
Stenmark et. al., Distinct structural elements of rab5 define its functional specificity. *EMBO J.*, 13(3): 575-83 (1994).
Strachan et. al. (Eds.), Diagram from text book entitled Human Molecular Genetics, 2nd Edition (1999).
Strachan et. al. (Eds.), Human Molecular Genetics, 1st Edition, p. 420 (1996).
Strachan et. al., (Eds.), Human Molecular Genetics, 2nd Edition, Figure 15.4 (1999).
Submission in response to oral proceedings in Opposition against European Patent No. 1721979, Opponent: Eli Lilly, dated Apr. 24, 2013.
Sudo et. al., In vitro differentiation and calcification in a new clonal osteogenic cell line derived from newborn mouse calvaria. *J. Cell Biol.*, 96:191-8 (1983).
Summons to attend oral proceedings for Opposition against European Patent No. 1133558, dated Nov. 4, 2008.
Summons to attend oral proceedings in Opposition against European Patent No. 1721979, dated Nov. 12, 2012.
Sutherland et. al., Sclerostin romotes the apoptosis of human osteoblastic cells: A novel regulation of bone formation. *Bone*, 35:828-35 (2004).
Suzawa et. al., Extracellular matrix-associated bone morphogenetic proteins are essential for differentiation of murine osteoblastic cells in vitro. *Endocrinology*, 140:2125-33 (1999).
Sverdlov et. al., Perpetually mobile footprints of ancient infections in human genome. *FEBS Lett.*, 428: 1-6 (1998).
Sylatron label, cited in Opposition against European Patent No. 1721979 by Opponent: Novartis AG, dated Jun. 15, 2011.
Takakura, Drug delivery systems in gene therapy. *Nippon Rinsho*, 56(3):691-5 (1998) (Abstract Only).
Takeda et. al., GenBank Sequence Database Accession No. AAB33865, May 27, 1995.
Takeda et. al., GenBank Sequence Database Accession No. D38082, dated Dec. 27, 2006.

(56) References Cited

OTHER PUBLICATIONS

Takeda et. al., GenBank Sequence Database Accession No. S75359, May 27, 1995.
Takeda et. al., NCBI Sequence Database Accession No. NM_030849, Feb. 11, 2009.
Takeda, Expression of serine/threonine kinase receptors during ectopic bone formation induced by bone morphogenetic protein (BMP). *Kokubyo Gakkai Zasshi*, 61(4):512-26 (1994).
Tam et. al., TGF-β receptor expression on human keratinocytes: A 150 kDa GPI-anchored TFF-β1 binding protein forms a heteromeric complex with type I and type II receptors. *J. Cellular Biochem.*, 70:573-56 (1998).
Taylor et. al., Human immunoglobulin transgenes undergo rearrangement, somatic mutation and class switching in mice that lack endogenous IgM. *Int. Immun.*, 6:579 (1994).
The Merck Manual-Second Home Edition, Ch. 61:1-3 (2005).
Thompson et. al., Affinity maturation of a high-affinity human monoclonal antibody against the third hypervariable loop of human immunodeficiency virus: Use of phage display to improve affinity and broaden strain reactivity. *J. Mol. Biol.*, 256:7-88 (1996).
Thornton et. al., Prediction of progress at last. *Nature*, 354:105-6 (1991).
Tjaderhane et. al., A high sucrose diet decreases the mechanical strength of bones in growing rats. *J. Nutr.*, 128: 1807-10 (1998).
Tuncay et. al., Oxygen tension regulates osteoblast function. *Am. J. Orthod. Dentofac. Orthop.*, 105: 457-63 (1994).
UCB and Amgen announce positive phase 2 results of CDP7851/AMG785 in patients with post menopausal osteoporosis (PMO), dated Apr. 21, 2011—Citation in Opposition against European Patent No. 1721979.
Uitterlinden et. al., Relation of alleles of the collagen type Iα1 gene to bone density and the risk of osteoporotic fractures in postmenopausal women. *New Engl. J. Med.*, 338: 1016-21 (1998).
Utting et al., Hypoxia stimulates osteoclast formation from human peripheral blood. *Cell Biochem. Funct.*, 28:374-80 (2010).
Valero et. al., Quaternary structure of casein kinase 2. *J. Biol. Chem.*, 27(14): 8345-52 (1995).
van Bezooijen et. al., Sclerostin is an osteocyte-expressed negative regulator of bone formation, but not a classical BMP antagonist. *J. Exp. Med.*, 199: 805-14 (2004).
van Bezooijen et. al., SOST/sclerostin, an osteocyte-derived negative regulator of bone formation, *Cytokine Growth Factor Rev.*, 16: 319-27 (2005).
van Bezooijen et. al., Wnt but not BMP signaling is involved in the inhibitory action of sclerostin on BMP-stimulated bone formation. *J. Bone. Miner. Res.*, 22:19-28 (2007).
Van Hul et. al., Van Buchem Disease (hyperostosis corticalis generalisata) maps to chromosome 17q12-a21. *Am. J. Hum. Genet.*, 2:391-9 (1998).
Vanier et. al., Recent advances in elucidating Niemann-Pick C disease. *Brain Pathol.*, 8: 163-74 (1998).
Veverka et. al., Characterization of the structural features and interactions of sclerostin. *J. Biol. Chem.*, 284(16): 10890-900 (2009).
Viter et. al., Analysis of antigenic structure of potato virus M Ukrainian strains. *Biopolimery I Kletka, Naukova Dumka, Kiev K, UK*, 16: 312-9 (2000).
Von Bubnoff et. al., Intracellular BMP signaling regulation in vertebrates: Pathway or network? *Dev. Biol.*, 239:1-14 (2001).
Wall, Transgenic livestock: Progress and prospects for the future. *Theriogenology*, 45:57-68 (1996).
Wang et. al., IFP 35 forms complexes with B-ATF, a member of the AP1 family of transcription factors. Biochem. Biophys. *Res. Commun.*, 229: 316-22 (1996).
Wang, Bone morphogenetic proteins (BMPs): Therapeutic potential in healing bony defects. *TIBTECH*, 11:379-83 (1993).
Warmington et. al., Sclerostin antagonism in adult rodents, via monoclonal antibody mediated blockade, increases bone mineral density and implicates sclerostia as a key regulator of bone mass during adulthood. *J. Bone Min. Res.*, 19:S56-7 (2004).
Warmington et. al., Sclerostin monoclonal antibody treatment of osteoporotic rats completely reverses one year of overiectomy-induced systemic bone loss. *J. Bone Min. Res.*, 20:S22 (2005).
Wehrman et al., A system for quantifying dynamic protein interactions defines a role for Herceptin in modulating ErbB2 interactions. *Proc. Natl. Acad. Sci. USA*, 103(50):19063-8 (2006).
Winkler et. al., Noggin and sclerostin bone morphogenetic protein antagonists form a mutually inhibitory complex. *J. Biol. Chem.*, 279(35): 36296-8 (2004).
Winkler et. al., Osteocyte control of bone formation via sclerostin, a novel BMP antagonist. *EMBO J.* 22: 6267-76 (2003).
Winkler et. al., Sclerostin inhibition of Wnt-3a-induced C3H10T1/2 cell differentiation is indirect and mediated by bone morphogenetic proteins. *J. Biol. Chem.* 280: 2498-502 (2005).
Winter et. al., Making antibodies by phase display technology. *Annu. Rev. Immunol.*, 12:433-55 (1994).
Wolff et. al., Monoclonal antibody homodimers: Enhanced antitumor activity in nude mice. Cancer Res., 53:2560-5 (1993).
Wollenberger et. al. (Eds.), Analytische Biochemie, Chapter 3, pp. 47-49 (2003).
Written submission—Observation by a Third Party According to Art.115 EPC, Opposition to European Patent No. 1133558, dated Nov. 25, 2008.
Written submission in response to summons to oral proceedings in Opposition against European Patent No. 1721979, Opponent: Norvartis AG, dated Feb. 25, 2013.
Written submission in response to summons to oral proceedings in Opposition against European Patent No. 1721979, Opponent: Eli Lilly Company, dated Feb. 25, 2013.
Written submission of Eli Lilly & Company to European Patent Office, Opposition to European Patent No. 1133558, dated May 29, 2007.
Written Submission of Eli Lilly & Company, Opposition to European Patent No. 1133558, dated Mar. 9, 2009.
Written submission of UCB S.A., Proprietor's Preliminary Response to the Opponent's submission of Mar. 9, 2009, Opposition to European Patent. No. 1133558, dated Mar. 20, 2009.
Written submission of UCB S.A., Proprietor's Response to Opposition against European Patent No. 1133558, dated Mar. 14, 2008.
Wu et al., Simultaneous targeting of multiple disease mediators by a dual-variable-domain immunoglobulin. *Nat. Biotechnol.*, 25:1290-7 (2007).
Yakes et al., Herceptin-induced inhibition of phosphatidylinositol-3 kinase and Akt is required for antibody-mediated effects on p27, cyclin D1, and antitumor action. *Cancer Res.*, 62(14):4132-41 (2002).
Yanagita et. al., USAG-1: A bone morphogenetic protein antagonist abundantly expressed in the kidney. *Biochem. Biophys. Res. Comm.* ,316: 490-550 (2004).
Yang et. al., CDR walking mutagenesis for the affinity maturation of a potent human Anti-HIV-1 antibody into the picomolar range. *J. Mol. Biol.*, 254:392-403 (1995).
Yates et. al., Inhibition of bone resorption by inorganic phosphate in mediated by both reduced osteoclast formation and decreased activity of mature osteoclasts. *J. Bone Miner. Res.*, 6(5): 476-8 (1990).
Yerges et. al., NCBI Sequence Database Accession No. NM_001203, Jul. 12, 2009.
Yerges et. al., NCBI Sequence Database Accession No. NP_001194, Jul. 12, 2009.
Yoshida et. al., Osteoinduction capability of recombinant human bone morphogenetic protein-2 in intramuscular and subcutaneous sites: An experimental study. *J. Cranio-Maxillofac. Surg.*, 26: 112-5 (1998).
Zambaux et. al., Influence of experimental parameters on the characteristics of poly(lactic acid) nanoparticles prepared by a double emulsion method. *J. Controlled Rel.*, 50(1-3):31-40 (1998).
Zamyatnin, Protein volume in solution. *Prog. Biophos. Mol. Biol.*, 24:107-23 (1972).
Zhang et. al., Humanization of an anti-human TNF-β antibody by variable region resurfacing with the aid of molecular modeling. *Molec. Immunol.*, 42(12):1445-51 (2005).

(56) References Cited

OTHER PUBLICATIONS

Zimmerman et. al., The spemann organizer signal noggin binds and inactives bone morphogenetic protein 4. *Cell*, 86(4):599-606 (1996).
Zlotogora et. al., Dominance and homozygosity. *Am. J. Med. Genet.*, 68: 412-6 (1997).
zur Muhlen et. al., Solid lipid nanoparticles (SLN) for controlled drug delivery—Drug release and release mechanism. *Eur. J. Pharm. Biopharm.*, 45(2):149-55 (1998).

* cited by examiner

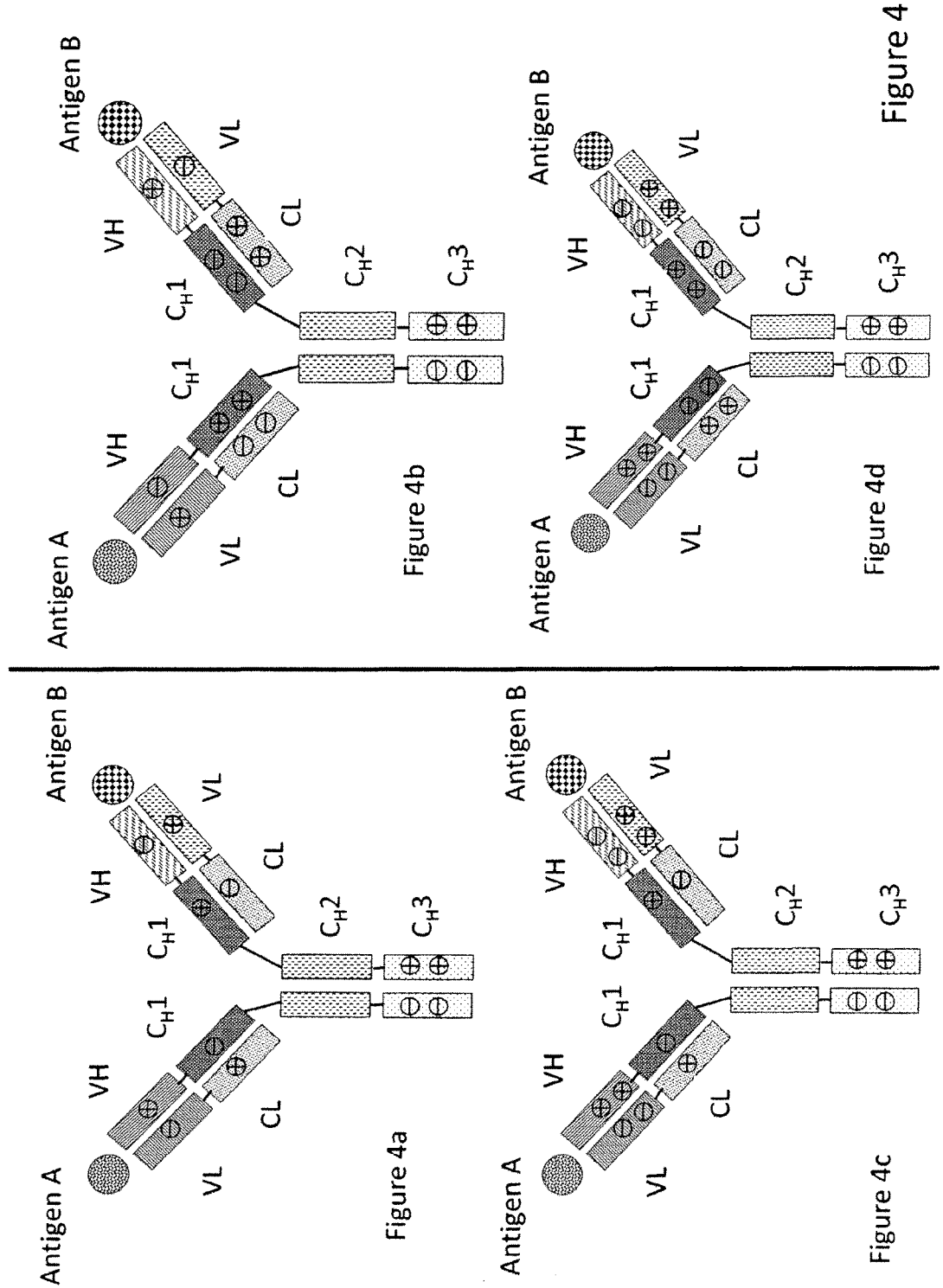

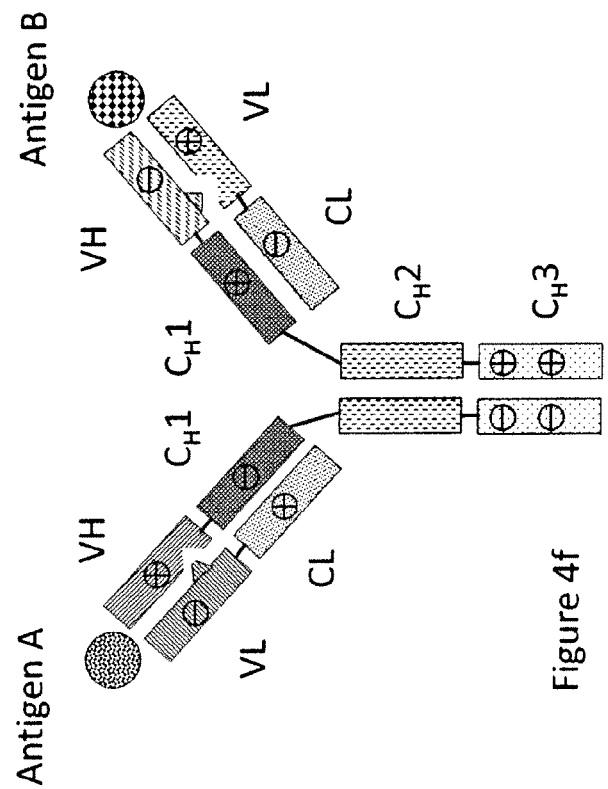
Figure 4f
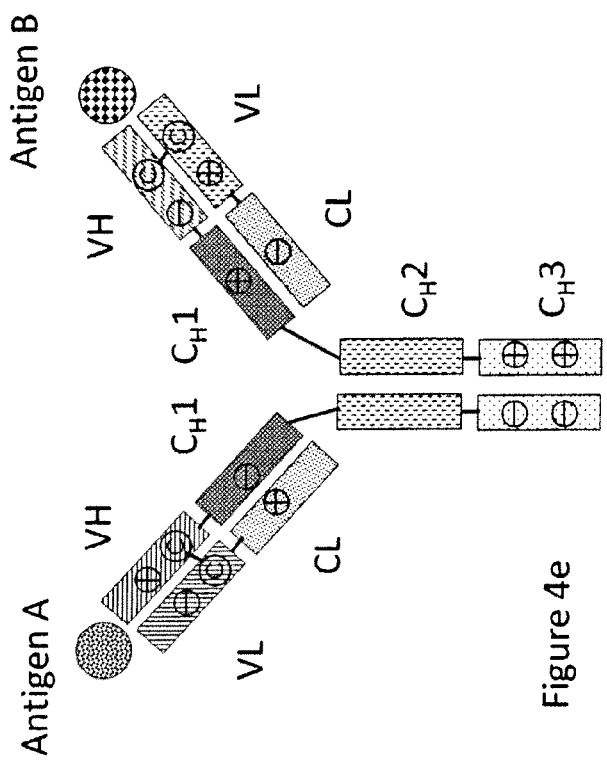
Figure 4e
Figure 4

FIGURE 5A

| Family | Sub | Gene | Sequence |
|---|---|---|---|
| VH1 | 1-3 | 1-02 | VQS GAEVKKPGASVKVSCKASG YTFTG YYM |
| | 1-3 | 1-03 | VQS GAEVKKPGASVKVSCKASG YTFTS YAM |
| | 1-3 | 1-08 | VQS GAEVKKPGASVKVSCKASG YTFTS YDI |
| | 1-2 | 1-18 | VQS GAEVKKPGASVKVSCKASG YTFTS YGI |
| | 1-U | 1-24 | VQS GAEVKKPGASVKVSCKVSG YTLTE LSM |
| | 1-3 | 1-45 | VQS GAEVKKTGSSVKVSCKASG YTFTY RYL |
| | 1-3 | 1-46 | VQS GAEVKKPGASVKVSCKASG YTFTS YYM |
| | 1-3 | 1-58 | VQS GPEVKKPGTSVKVSCKASG FTFTS SAV |
| | 1-2 | 1-69 | VQS GAEVKKPGSSVKVSCKASG GTFSS YAI |
| | 1-2 | 1-e | VQS GAEVKKPGSSVKVSCKASG GTFSS YAI |
| | 1-2 | 1-f | VQS GAEVKKPGATVKISCKVSG YTFTD YYM |
| VH2 | 3-1/2-1 | 2-05 | LKES GPTLVKPTQTLTLTCTFSG FSLSTS GVGV |
| | 3-1 | 2-26 | LKES GPVLVKPTETLTLTCTVSG FSLSNA RMGV |
| | 3-1 | 2-70 | LKES GPALVKPTQTLTLTCTFSG FSLSTS GMRV |
| VH3 | 1-3 | 3-07 | VES GGGLVQPGGSLRLSCAASG FTFSS YWM |
| | 1-3 | 3-09 | VES GGGLVQPGRSLRLSCAASG FTFDD YAM |
| | 1-3 | 3-11 | VES GGGLVKPGGSLRLSCAASG FTFSD YYM |
| | 1-1 | 3-13 | VES GGGLVQPGGSLRLSCAASG FTFSS YDM |
| | 1-U | 3-15 | VES GGGLVKPGGSLRLSCAASG FTFSN AWM |
| | 1-3 | 3-20 | VES GGGVVRPGGSLRLSCAASG FTFDD YGM |
| | 1-3 | 3-21 | VES GGGLVKPGGSLRLSCAASG FTFSS YSM |
| | 1-3 | 3-23 | LES GGGLVQPGGSLRLSCAASG FTFSS YAM |
| | 1-3 | 3-30 | VES GGGVVQPGRSLRLSCAASG FTFSS YGM |
| | 1-3 | 3-30.3 | VES GGGVVQPGRSLRLSCAASG FTFSS YAM |
| | 1-3 | 3-30.5 | VES GGGVVQPGRSLRLSCAASG FTFSS YGM |
| | 1-3 | 3-33 | VES GGGVVQPGRSLRLSCAASG FTFSS YGM |
| | 1-3 | 3-43 | VES GGVVVQPGGSLRLSCAASG FTFDD YTM |
| | 1-3 | 3-48 | VES GGGLVQPGGSLRLSCAASG FTFSS YSM |
| | 1-U | 3-49 | VES GGGLVQPGRSLRLSCTASG FTFGD YAM |
| | 1-1 | 3-53 | VET GGGLIQPGGSLRLSCAASG FTVSS NYM |
| | 1-3 | 3-64 | VES GGGLVQPGGSLRLSCAASG FTFSS YAM |
| | 1-1 | 3-66 | VES GGGLVQPGGSLRLSCAASG FTVSS NYM |
| | 1-4 | 3-72 | VES GGGLVQPGGSLRLSCAASG FTFSD HYM |
| | 1-4 | 3-73 | VES GGGLVQPGGSLKLSCAASG FTFSG SAM |
| | 1-3 | 3-74 | VES GGGLVQPGGSLRLSCAASG FTFSS YWM |
| | 1-6 | 3-d | VES RGVLVQPGGSLRLSCAASG FTVSS NEM |
| VH4 | 2-1/1-1 | 4-04 | LQES GPGLVKPSGTLSLTCAVSG GSISSS NWW |
| | 2-1 | 4-28 | LQES GPGLVKPSDTLSLTCAVSG YSISSS NWW |
| | 3-1 | 4-30.1 | LQES GPGLVKPSQTLSLTCTVSG GSISSG GYYW |
| | 3-1 | 4-30.2 | LQES GSGLVKPSQTLSLTCAVSG GSISSG GYSW |
| | 3-1 | 4-30.4 | LQES GPGLVKPSQTLSLTCTVSG GSISSG DYYW |
| | 3-1 | 4-31 | LQES GPGLVKPSQTLSLTCTVSG GSISSG GYYW |
| | 1-1 | 4-34 | LQQW GAGLLKPSETLSLTCAVYG GSFSG YYW |
| | 3-1 | 4-39 | LQES GPGLVKPSETLSLTCTVSG GSISSS SYYW |
| | 1-1 | 4-59 | LQES GPGLVKPSETLSLTCTVSG GSISS YYW |
| | 3-1 | 4-61 | LQES GPGLVKPSETLSLTCTVSG GSVSSG SYYW |
| | 2-1 | 4-b | LQES GPGLVKPSETLSLTCAVSG YSISSG YYW |
| VH5 | 1-2 | 5-51 | VQS GAEVKKPGESLKISCKGSG YSFTS YWI |
| | 1-2 | 5-a | VQS GAEVKKPGESLRISCKGSG YSFTS YWI |
| VH6 | 3-5 | 6-01 | LQQS GPGLVKPSQTLSLTCAISG DSVSSN SAAW |
| VH7 | 1-2 | 7-4.1 | VQS GSELKKPGASVKVSCKASG YTFTS YAM |

FIGURE 5B

| | | | | | |
|---|---|---|---|---|---|
| VH1 | 1-3 | 1-02 | APG...MG. INPN | SGGTN.AQKFQGRVTMTRDTSISTAYME | |
| | 1-3 | 1-03 | APG...MG. INAG | NGNTK.SQKFQGRVTITRDTSASTAYME | |
| | 1-3 | 1-08 | ATG...MG.MNPN | SGNTG.AQKFQGRVTMTRNTSISTAYME | |
| | 1-2 | 1-18 | APG...MG. ISAY | NGNTN.AQKLQGRVTMTTDTSTSTAYME | |
| | 1-U | 1-24 | APG...MG.FDPE | DGETI.AQKFQGRVTMTEDTSTDTAYME | |
| | 1-3 | 1-45 | APG...MG. ITPF | NGNTN.AQKFQDRVTITRDRSMSTAYME | |
| | 1-3 | 1-46 | APG...MG. INPS | GGSTS.AQKFQGRVTMTRDTSTSTVYME | |
| | 1-3 | 1-58 | ARG...IG. IVVG | SGNTN.AQKFQERVTITRDMSTSTAYME | |
| | 1-2 | 1-69 | APG...MG. IIPI | FGTAN.AQKFQGRVTITADESTSTAYME | |
| | 1-2 | 1-e | APG...MG. IIPI | FGTAN.AQKFQGRVTITADKSTSTAYME | |
| | 1-2 | 1-f | APG...MG.VDPE | DGETI.AEKFQGRVTITADTSTDTAYME | |
| VH2 | 3-1/2-1 | 2-05 | PPG...LA. IYW | NDDKR.SPSLKSRLTITKDTSKNQVVLT | |
| | 3-1 | 2-26 | PPG...LA. IFS | NDEKS.STSLKSRLTISKDTSKSQVVLT | |
| | 3-1 | 2-70 | PPG...LA. IDW | DDDKF.STSLKTRLTISKDTSKNQVVLT | |
| VH3 | 1-3 | 3-07 | APG...VA. IKQD | GSEKY.VDSVKGRFTISRDNAKNSLYLQ | |
| | 1-3 | 3-09 | APG...VS. ISWN | SGSIG.ADSVKGRFTISRDNAKNSLYLQ | |
| | 1-3 | 3-11 | APG...VS. ISSS | GSTIY.ADSVKGRFTISRDNAKNSLYLQ | |
| | 1-1 | 3-13 | ATG...VS. IGT | AGDTY.PGSVKGRFTISRENAKNSLYLQ | |
| | 1-U | 3-15 | APG...VG. IKSKT | DGGTTD.AAPVKGRFTISRDDSKNTLYLQ | |
| | 1-3 | 3-20 | APG...VS. INWN | GGSTG.ADSVKGRFTISRDNAKNSLYLQ | |
| | 1-3 | 3-21 | APG...VS. ISSS | SSYIY.ADSVKGRFTISRDNAKNSLYLQ | |
| | 1-3 | 3-23 | APG...VS. ISGS | GGSTY.ADSVKGRFTISRDNSKNTLYLQ | |
| | 1-3 | 3-30 | APG...VA. ISYD | GSNKY.ADSVKGRFTISRDNSKNTLYLQ | |
| | 1-3 | 3-30.3 | APG...VA. ISYD | GSNKY.ADSVKGRFTISRDNSKNTLYLQ | |
| | 1-3 | 3-30.5 | APG...VA. ISYD | GSNKY.ADSVKGRFTISRDNSKNTLYLQ | |
| | 1-3 | 3-33 | APG...VA. IWYD | GSNKY.ADSVKGRFTISRDNSKNTLYLQ | |
| | 1-3 | 3-43 | APG...VS. ISWD | GGSTY.ADSVKGRFTISRDNSKNSLYLQ | |
| | 1-3 | 3-48 | APG...VS. ISSS | SSTIY.ADSVKGRFTISRDNAKNSLYLQ | |
| | 1-U | 3-49 | APG...VG. IRSKA | YGGTTE.TASVKGRFTISRDGSKSIAYLQ | |
| | 1-1 | 3-53 | APG...VS. IYS | GGSTY.ADSVKGRFTISRDNSKNTLYLQ | |
| | 1-3 | 3-64 | APG...VS. ISSN | GGSTY.ANSVKGRFTISRDNSKNTLYLQ | |
| | 1-1 | 3-66 | APG...VS. IYS | GGSTY.ADSVKGRFTISRDNSKNTLYLQ | |
| | 1-4 | 3-72 | APG...VG.TRNKA | NSYTTE.AASVKGRFTISRDDSKNSLYLQ | |
| | 1-4 | 3-73 | ASG...VG. IRSKA | NSYATA.AASVKGRFTISRDDSKNTAYLQ | |
| | 1-3 | 3-74 | APG...VS. INSD | GSSTS.ADSVKGRFTISRDNAKNTLYLQ | |
| | 1-6 | 3-d | APG...VS. ISG | GSTY.ADSRKGRFTISRDNSKNTLHLQ | |
| VH4 | 2-1/1-1 | 4-04 | PPG...IG. IYH | SGSTN.NPSLKSRVTISVDKSKNQFSLK | |
| | 2-1 | 4-28 | PPG...IG. IYY | SGSTY.NPSLKSRVTMSVDTSKNQFSLK | |
| | 3-1 | 4-30.1 | HPG...IG. IYY | SGSTY.NPSLKSRVTISVDTSKNQFSLK | |
| | 3-1 | 4-30.2 | PPG...IG. IYH | SGSTY.NPSLKSRVTISVDRSKNQFSLK | |
| | 3-1 | 4-30.4 | PPG...IG. IYY | SGSTY.NPSLKSRVTISVDTSKNQFSLK | |
| | 3-1 | 4-31 | HPG...IG. IYY | SGSTY.NPSLKSRVTISVDTSKNQFSLK | |
| | 1-1 | 4-34 | PPG...IG. INH | SGSTN.NPSLKSRVTISVDTSKNQFSLK | |
| | 3-1 | 4-39 | PPG...IG. IYY | SGSTY.NPSLKSRVTISVDTSKNQFSLK | |
| | 1-1 | 4-59 | PPG...IG. IYY | SGSTN.NPSLKSRVTISVDTSKNQFSLK | |
| | 3-1 | 4-61 | PPG...IG. IYY | SGSTN.NPSLKSRVTISVDTSKNQFSLK | |
| | 2-1 | 4-b | PPG...IG. IYH | SGSTY.NPSLKSRVTISVDTSKNQFSLK | |
| VH5 | 1-2 | 5-51 | MPG...MG. IYPG | DSDTR.SPSFQGQVTISADKSISTAYLQ | |
| | 1-2 | 5-a | MPG...MG. IDPS | DSYTN.SPSFQGHVTISADKSISTAYLQ | |
| VH6 | 3-5 | 6-01 | SPS...LG.TYYR | SKWYND.AVSVKSRITINPDTSKNQFSLQ | |
| VH7 | 1-2 | 7-4.1 | APG...MG. INTN | TGNPT.AQGFTGRFVFSLDTSVSTAYLQ | |

FIGURE 5C

| | | | | |
|---|---|---|---|---|
| VH1 | 1-3 | 1-02 | LSRLRSDDTA_Y_C_R | SEQ ID NO: 1034 |
| | 1-3 | 1-03 | LSSLRSEDTA_Y_C_R | SEQ ID NO: 1035 |
| | 1-3 | 1-08 | LSSLRSEDTA_Y_C_R | SEQ ID NO: 1036 |
| | 1-2 | 1-18 | LRSLRSDDTA_Y_C_R | SEQ ID NO: 1037 |
| | 1-U | 1-24 | LSSLRSEDTA_Y_C_T | SEQ ID NO: 1038 |
| | 1-3 | 1-45 | LSSLRSEDTA_Y_C_R | SEQ ID NO: 1039 |
| | 1-3 | 1-46 | LSSLRSEDTA_Y_C_R | SEQ ID NO: 1040 |
| | 1-3 | 1-58 | LSSLRSEDTA_Y_C_A | SEQ ID NO: 1041 |
| | 1-2 | 1-69 | LSSLRSEDTA_Y_C_R | SEQ ID NO: 1042 |
| | 1-2 | 1-e | LSSLRSEDTA_Y_C_R | SEQ ID NO: 1043 |
| | 1-2 | 1-f | LSSLRSEDTA_Y_C_T | SEQ ID NO: 1044 |
| VH2 | 3-1/2-1 | 2-05 | MTNMDPVDTA_Y_C_H | SEQ ID NO: 1045 |
| | 3-1 | 2-26 | MTNMDPVDTA_Y_C_R | SEQ ID NO: 1046 |
| | 3-1 | 2-70 | MTNMDPVDTA_Y_C_R | SEQ ID NO: 1047 |
| VH3 | 1-3 | 3-07 | MNSLRAEDTA_Y_C_R | SEQ ID NO: 1048 |
| | 1-3 | 3-09 | MNSLRAEDTA_Y_C_K | SEQ ID NO: 1049 |
| | 1-3 | 3-11 | MNSLRAEDTA_Y_C_R | SEQ ID NO: 1050 |
| | 1-1 | 3-13 | MNSLRAGDTA_Y_C_R | SEQ ID NO: 1051 |
| | 1-U | 3-15 | MNSLKTEDTA_Y_C_T | SEQ ID NO: 1052 |
| | 1-3 | 3-20 | MNSLRAEDTA_Y_C_R | SEQ ID NO: 1053 |
| | 1-3 | 3-21 | MNSLRAEDTA_Y_C_R | SEQ ID NO: 1054 |
| | 1-3 | 3-23 | MNSLRAEDTA_Y_C_K | SEQ ID NO: 1055 |
| | 1-3 | 3-30 | MNSLRAEDTA_Y_C_K | SEQ ID NO: 1056 |
| | 1-3 | 3-30.3 | MNSLRAEDTA_Y_C_R | SEQ ID NO: 1057 |
| | 1-3 | 3-30.5 | MNSLRAEDTA_Y_C_K | SEQ ID NO: 1058 |
| | 1-3 | 3-33 | MNSLRAEDTA_Y_C_R | SEQ ID NO: 1059 |
| | 1-3 | 3-43 | MNSLRTEDTA_Y_C_K | SEQ ID NO: 1060 |
| | 1-3 | 3-48 | MNSLRDEDTA_Y_C_R | SEQ ID NO: 1061 |
| | 1-U | 3-49 | MNSLKTEDTA_Y_C_R | SEQ ID NO: 1062 |
| | 1-1 | 3-53 | MNSLRAEDTA_Y_C_R | SEQ ID NO: 1063 |
| | 1-3 | 3-64 | MGSLRAEDMA_Y_C_R | SEQ ID NO: 1064 |
| | 1-1 | 3-66 | MNSLRAEDTA_Y_C_R | SEQ ID NO: 1065 |
| | 1-4 | 3-72 | MNSLKTEDTA_Y_C_R | SEQ ID NO: 1066 |
| | 1-4 | 3-73 | MNSLKTEDTA_Y_C_R | SEQ ID NO: 1067 |
| | 1-3 | 3-74 | MNSLRAEDTA_Y_C_R | SEQ ID NO: 1068 |
| | 1-6 | 3-d | MNSLRAEDTA_Y_C_K | SEQ ID NO: 1069 |
| VH4 | 2-1/1-1 | 4-04 | LSSVTAADTA_Y_C_R | SEQ ID NO: 1070 |
| | 2-1 | 4-28 | LSSVTAVDTA_Y_C_R | SEQ ID NO: 1071 |
| | 3-1 | 4-30.1 | LSSVTAADTA_Y_C_R | SEQ ID NO: 1072 |
| | 3-1 | 4-30.2 | LSSVTAADTA_Y_C_R | SEQ ID NO: 1073 |
| | 3-1 | 4-30.4 | LSSVTAADTA_Y_C_R | SEQ ID NO: 1074 |
| | 3-1 | 4-31 | LSSVTAADTA_Y_C_R | SEQ ID NO: 1075 |
| | 1-1 | 4-34 | LSSVTAADTA_Y_C_R | SEQ ID NO: 1076 |
| | 3-1 | 4-39 | LSSVTAADTA_Y_C_R | SEQ ID NO: 1077 |
| | 1-1 | 4-59 | LSSVTAADTA_Y_C_R | SEQ ID NO: 1078 |
| | 3-1 | 4-61 | LSSVTAADTA_Y_C_R | SEQ ID NO: 1079 |
| | 2-1 | 4-b | LSSVTAADTA_Y_C_R | SEQ ID NO: 1080 |
| VH5 | 1-2 | 5-51 | WSSLKASDTA_Y_C_R | SEQ ID NO: 1081 |
| | 1-2 | 5-a | WSSLKASDTA_Y_C_R | SEQ ID NO: 1082 |
| VH6 | 3-5 | 6-01 | LNSVTPEDTA_Y_C_R | SEQ ID NO: 1083 |
| VH7 | 1-2 | 7-4.1 | ICSLKAEDTA_Y_C_R | SEQ ID NO: 1084 |

FIGURE 6A

| Family | Gene | Clone | Sequence |
|---|---|---|---|
| VKI | 2-1-(1) | O12 | D I Q M T Q S P S S L S A S V G D R V T I T C R A S   Q S I S |
|  | 2-1-(1) | O2 | D I Q M T Q S P S S L S A S V G D R V T I T C R A S   Q S I S |
|  | 2-1-(1) | O18 | D I Q M T Q S P S S L S A S V G D R V T I T C Q A S   Q D I S |
|  | 2-1-(1) | O8 | D I Q M T Q S P S S L S A S V G D R V T I T C Q A S   Q D I S |
|  | 2-1-(U) | A20 | D I Q M T Q S P S S L S A S V G D R V T I T C R A S   Q G I S |
|  | 2-1-(1) | A30 | D I Q M T Q S P S S L S A S V G D R V T I T C R A S   Q G I R |
|  | 2-1-(1) | L14 | N I Q M T Q S P S A M S A S V G D R V T I T C R A R   Q G I S |
|  | 2-1-(1) | L1 | D I Q M T Q S P S S L S A S V G D R V T I T C R A S   Q G I S |
|  | 2-1-(1) | L15 | D I Q M T Q S P S S L S A S V G D R V T I T C R A S   Q G I S |
|  | 2-1-(1) | L4 | A I Q L T Q S P S S L S A S V G D R V T I T C R A S   Q G I S |
|  | 2-1-(1) | L18 | A I Q L T Q S P S S L S A S V G D R V T I T C R A S   Q G I S |
|  | 2-1-(1) | L5 | D I Q M T Q S P S S V S A S V G D R V T I T C R A S   Q G I S |
|  | 2-1-(1) | L19 | D I Q M T Q S P S S V S A S V G D R V T I T C R A S   Q G I S |
|  | 2-1-(1) | L8 | D I Q L T Q S P S F L S A S V G D R V T I T C R A S   Q G I S |
|  | 2-1-(1) | L23 | A I R M T Q S P F S L S A S V G D R V T I T C W A S   Q G I S |
|  | 2-1-(1) | L9 | A I R M T Q S P S S F S A S T G D R V T I T C R A S   Q G I S |
|  | U-1-(1) | L24 | V I W M T Q S P S L L S A S T G D R V T I S C R M S   Q G I S |
|  | 2-1-(1) | L11 | A I Q M T Q S P S S L S A S V G D R V T I T C R A S   Q G I R |
|  | 2-1-(U) | L12 | D I Q M T Q S P S T L S A S V G D R V T I T C R A S   Q S I S |
| VKII | 3-1-(1) | O11 | D I V M T Q T P L S L P V T P G E P A S I S C R S S   Q S L L D S D D G N |
|  | 3-1-(1) | O1 | D I V M T Q T P L S L P V T P G E P A S I S C R S S   Q S L L D S D D G N |
|  | 4-1-(1) | A17 | D V V M T Q S P L S L P V T L G Q P A S I S C R S S   Q S L V Y S D   G N |
|  | 4-1-(1) | A1 | D V V M T Q S P L S L P V T L G Q P A S I S C R S S   Q S L V Y S D   G N |
|  | 4-1-(1) | A18 | D I V M T Q T P L S L S V T P G Q P A S I S C K S S   Q S L L H S D   G K |
|  | 4-1-(1) | A2 | D I V M T Q T P L S L S V T P G Q P A S I S C K S S   Q S L L H S D   G K |
|  | 4-1-(1) | A19 | D I V M T Q S P L S L P V T P G E P A S I S C R S S   Q S L L H S N   G Y |
|  | 4-1-(1) | A3 | D I V M T Q S P L S L P V T P G E P A S I S C R S S   Q S L L H S N   G Y |
|  | 4-1-(1) | A23 | D I V M T Q T P L S S P V T L G Q P A S I S C R S S   Q S L V H S D   G N |
| VKIII | 6-1-(1) | A27 | E I V L T Q S P G T L S L S P G E R A T L S C R A S   Q S V S S |
|  | 6-1-(1) | A11 | E I V L T Q S P A T L S L S P G E R A T L S C G A S   Q S V S S |
|  | 2-1-(1) | L2 | E I V M T Q S P A T L S V S P G E R A T L S C R A S   Q S V S |
|  | 2-1-(1) | L16 | E I V M T Q S P A T L S V S P G E R A T L S C R A S   Q S V S |
|  | 2-1-(1) | L6 | E I V L T Q S P A T L S L S P G E R A T L S C R A S   Q S V S |
|  | 2-1-(U) | L20 | E I V L T Q S P A T L S L S P G E R A T L S C R A S   Q G V S |
|  | 6-1-(1) | L25 | E I V M T Q S P A T L S L S P G E R A T L S C R A S   Q S V S S |
| VKIV | 3-1-(1) | B3 | D I V M T Q S P D S L A V S L G E R A T I N C K S S   Q S V L Y S S N N K |
| VKV | 2-1-(1) | B2 | E T T L T Q S P A F M S A T P G D K V N I S C K A S   Q D I D |
| VKVI | 2-1-(1) | A26 | E I V L T Q S P D F Q S V T P K E K V T I T C R A S   Q S I G |
|  | 2-1-(1) | A10 | E I V L T Q S P D F Q S V T P K E K V T I T C R A S   Q S I G |
|  | 2-1-(1) | A14 | D V V M T Q S P A F L S V T P G E K V T I T C Q A S   E G I G |

FIGURE 6B

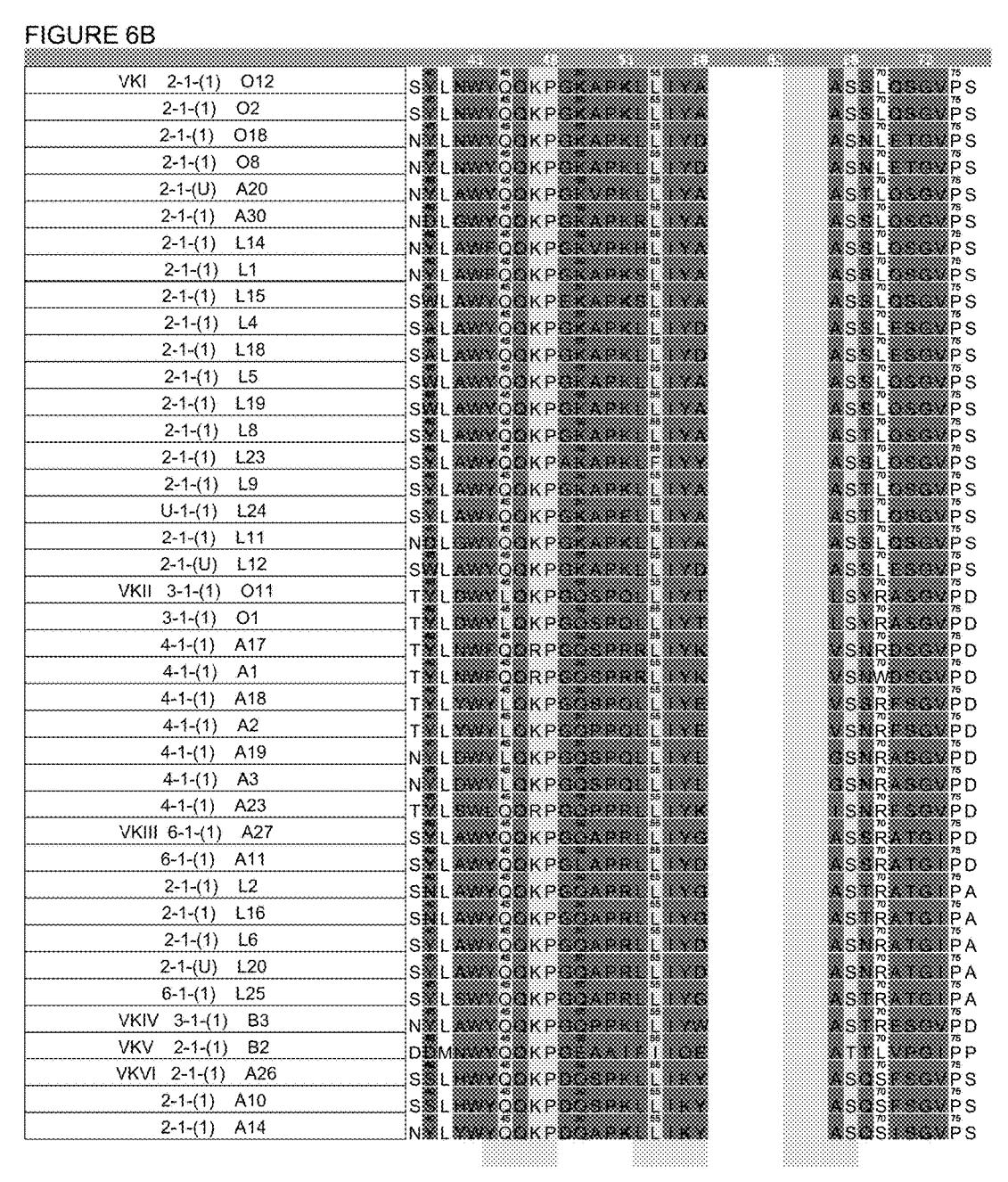

| | | |
|---|---|---|
| VKI | 2-1-(1) | O12 |
| | 2-1-(1) | O2 |
| | 2-1-(1) | O18 |
| | 2-1-(1) | O8 |
| | 2-1-(U) | A20 |
| | 2-1-(1) | A30 |
| | 2-1-(1) | L14 |
| | 2-1-(1) | L1 |
| | 2-1-(1) | L15 |
| | 2-1-(1) | L4 |
| | 2-1-(1) | L18 |
| | 2-1-(1) | L5 |
| | 2-1-(1) | L19 |
| | 2-1-(1) | L8 |
| | 2-1-(1) | L23 |
| | 2-1-(1) | L9 |
| | U-1-(1) | L24 |
| | 2-1-(1) | L11 |
| | 2-1-(U) | L12 |
| VKII | 3-1-(1) | O11 |
| | 3-1-(1) | O1 |
| | 4-1-(1) | A17 |
| | 4-1-(1) | A1 |
| | 4-1-(1) | A18 |
| | 4-1-(1) | A2 |
| | 4-1-(1) | A19 |
| | 4-1-(1) | A3 |
| | 4-1-(1) | A23 |
| VKIII | 6-1-(1) | A27 |
| | 6-1-(1) | A11 |
| | 2-1-(1) | L2 |
| | 2-1-(1) | L16 |
| | 2-1-(1) | L6 |
| | 2-1-(U) | L20 |
| | 6-1-(1) | L25 |
| VKIV | 3-1-(1) | B3 |
| VKV | 2-1-(1) | B2 |
| VKVI | 2-1-(1) | A26 |
| | 2-1-(1) | A10 |
| | 2-1-(1) | A14 |

FIGURE 6C

| | | | | SEQ ID NO |
|---|---|---|---|---|
| VKI 2-1-(1) O12 | RFSGSGSG | TDFTLTISSLQPEDFA | Y C   YST | 1091 |
| 2-1-(1) O2 | RFSGSGSG | TDFTLTISSLQPEDFA | Y C   YST | 1092 |
| 2-1-(1) O18 | RFSGSGSG | TDFTFTISSLQPEDIA | Y C   DNL | 1093 |
| 2-1-(1) O8 | RFSGSGSG | TDFTFTISSLQPEDIA | Y C   DNL | 1094 |
| 2-1-(U) A20 | RFSGSGSG | TDFTLTISSLQPEDVA | Y C   NSA | 1095 |
| 2-1-(1) A30 | RFSGSGSG | TEFTLTISSLQPEDFA | Y C   NSY | 1096 |
| 2-1-(1) L14 | RFSGSGSG | TEFTLTISSLQPEDFA | Y C   NSY | 1097 |
| 2-1-(1) L1 | RFSGSGSG | TDFTLTISSLQPEDFA | Y C   NSY | 1098 |
| 2-1-(1) L15 | RFSGSGSG | TDFTLTISSLQPEDFA | Y C   NSY | 1099 |
| 2-1-(1) L4 | RFSGSGSG | TDFTLTISSLQPEDFA | Y C   NSY | 1100 |
| 2-1-(1) L18 | RFSGSGSG | TDFTLTISSLQPEDFA | Y C   NSY | 1101 |
| 2-1-(1) L5 | RFSGSGSG | TDFTLTISSLQPEDFA | Y C   NSF | 1102 |
| 2-1-(1) L19 | RFSGSGSG | TDFTLTISSLQPEDFA | Y C   NSF | 1103 |
| 2-1-(1) L8 | RFSGSGSG | TEFTLTISSLQPEDFA | Y C   NSY | 1104 |
| 2-1-(1) L23 | RFSGSGSG | TDYTLTISSLQPEDFA | Y C   YST | 1105 |
| 2-1-(1) L9 | RFSGSGSG | TDFTLTISCLQSEDFA | Y C   YSY | 1106 |
| U-1-(1) L24 | RFSGSGSG | TDFTLTISCLQSEDFA | Y C   YSF | 1107 |
| 2-1-(1) L11 | RFSGSGSG | TDFTLTISSLQPEDFA | Y C   YNY | 1108 |
| 2-1-(U) L12 | RFSGSGSG | TEFTLTISSLQPDDFA | Y C   NSY | 1109 |
| VKII 3-1-(1) O11 | RFSGSGSG | TDFTLKISRVEAEDVG | Y C   IEF | 1110 |
| 3-1-(1) O1 | RFSGSGSG | TDFTLKISRVEAEDVG | Y C   IEF | 1111 |
| 4-1-(1) A17 | RFSGSGSG | TDFTLKISRVEAEDVG | Y C   THW | 1112 |
| 4-1-(1) A1 | RFSGSGSG | TDFTLKISRVEAEDVG | Y C   THW | 1113 |
| 4-1-(1) A18 | RFSGSGSG | TDFTLKISRVEAEDVG | Y C   IHL | 1114 |
| 4-1-(1) A2 | RFSGSGSG | TDFTLKISRVEAEDVG | Y C   IQL | 1115 |
| 4-1-(1) A19 | RFSGSGSG | TDFTLKISRVEAEDVG | Y C   LQT | 1116 |
| 4-1-(1) A3 | RFSGSGSG | TDFTLKISRVEAEDVG | Y C   LQT | 1117 |
| 4-1-(1) A23 | RFSGSGAG | TDFTLKISRVEAEDVG | Y C   TQF | 1118 |
| VKIII 6-1-(1) A27 | RFSGSGSG | TDFTLTISRLEPEDFA | Y C   GSS | 1119 |
| 6-1-(1) A11 | RFSGSGSG | TDFTLTISRLEPEDFA | Y C   GSS | 1120 |
| 2-1-(1) L2 | RFSGSGSG | TEFTLTISSLQSEDFA | Y C   NNW | 1121 |
| 2-1-(1) L16 | RFSGSGSG | TEFTLTISSLQSEDFA | Y C   NNW | 1122 |
| 2-1-(1) L6 | RFSGSGSG | TDFTLTISSLEPEDFA | Y C   SNW | 1123 |
| 2-1-(U) L20 | RFSGSGPG | TDFTLTISSLEPEDFA | Y C   SNW | 1124 |
| 6-1-(1) L25 | RFSGSGSG | TDFTLTISSLQPEDFA | Y C   YNL | 1125 |
| VKIV 3-1-(1) B3 | RFSGSGSG | TDFTLTISSLQAEDVA | Y C   YST | 1126 |
| VKV 2-1-(1) B2 | RFSGSGYG | TDFTLTINNIESEDAA | Y C   DNF | 1127 |
| VKVI 2-1-(1) A26 | RFSGSGSG | TDFTLTINSLEAEDAA | Y C   SSL | 1128 |
| 2-1-(1) A10 | RFSGSGSG | TDFTLTINSLEAEDAA | Y C   SSL | 1129 |
| 2-1-(1) A14 | RFSGSGSG | TDFTFTISSLEAEDAA | Y C   NKH | 1130 |

FIGURE 7A

| | | | |
|---|---|---|---|
| VL1 | 13-7(A) | 1a | QSVLTQP PSVSEAPRQRVT ISCSGSS SNIGN |
| | 14-7(A) | 1e | QSVLTQP PSVSGAPGQRVT ISCTGSS SNIGAG |
| | 13-7(A) | 1c | QSVLTQP PSASGTPGQRVT ISCSGSS SNIGS |
| | 13-7(A) | 1g | QSVLTQP PSASGTPGQRVT ISCSGSS SNIGS |
| | 13-7(A) | 1b | QSVLTQP PSVSAAPGQKVT ISCSGSS SNIGN |
| VL2 | 14-7(A) | 2c | QSALTQP PSASGSPGQSVT ISCTGTS SDVGGY |
| | 14-7(A) | 2e | QSALTQP RSVSGSPGQSVT ISCTGTS SDVGGY |
| | 14-7(A) | 2a2 | QSALTQP ASVSGSPGQSIT ISCTGTS SDVGGY |
| | 14-7(A) | 2d | QSALTQP PSVSGSPGQSVT ISCTGTS SDVGSY |
| | 14-7(A) | 2b2 | QSALTQP ASVSGSPGQSIT ISCTGTS SDVGSY |
| VL3 | 11-7 | 3r | SYELTQP PSVSVSPGQTAS ITCSGD KLGD |
| | 11-7 | 3j | SYELTQP LSVSVALGQTAR ITCGGN NIGS |
| | 11-7 | 3p | SYELTQP PSVSVSPGQTAR ITCSGD ALPK |
| | 11-7 | 3a | SYELTQP PSVSVSLGQMAR ITCSGE ALPK |
| | 11-7 | 3l | SSELTQD PAVSVALGQTVR ITCQGD SLRS |
| | 11-7 | 3h | SYVLTQP PSVSVAPGKTAR ITCGGN NIGS |
| | 11-7 | 3e | SYELTQL PSVSVSPGQTAR ITCSGD VLGE |
| | 11-7 | 3m | SYELMQP PSVSVSPGQTAR ITCSGD ALPK |
| | 11-7 | 2-19 | SYELTQP SSVSVSPGQTAR ITCSGD VLAK |
| VL4 | 12-11 | 4c | LPVLTQP PSASALLGASIK LTCTLSS EHSTY |
| | 12-11 | 4a | QPVLTQS SSASASLGSSVK LTCTLSS GHSSY |
| | 12-11 | 4b | QLVLTQS PSASASLGASVK LTCTLSS GHSSY |
| VL5 | 14-11 | 5e | QPVLTQP PSSSASPGESAR LTCTLPS DINVGS |
| | 14-11 | 5c | QAVLTQP ASLSASPGASAS LTCTLRS GINVGT |
| | 14-11 | 5b | QPVLTQP SSHSASSGASVR LTCMLSS GFSVGD |
| VL6 | 13-7(B) | 6a | NFMLTQP HSVSESPGKTVT ISCTRSS GSIAS |
| VL7 | 14-7(B) | 7a | QTVVTQE PSLTVSPGGTVT LTCASST GAVTSG |
| | 14-7(B) | 7b | QAVVTQE PSLTVSPGGTVT LTCGSST GAVTSG |
| VL8 | 14-7(B) | 8a | QTVVTQE PSFSVSPGGTVT LTCGLSS GSVSTS |
| VL9 | 12-12 | 9a | QPVLTQP PSASASLGASVT LTCTLSS GYSNY |
| VL10 | 13-7(C) | 10a | QAGLTQP PSVSKGLRQTAT LTCTGNS NNVGN |

FIGURE 7B

| | | | | | |
|---|---|---|---|---|---|
| VL1 | 13-7(A) | 1a | N_V_W___LPG_____L_I__ | | DDLLPSGVSD |
| | 14-7(A) | 1e | Y_V_W___LPG_____L_I__ | | NSNRPSGVPD |
| | 13-7(A) | 1c | N_V_W___LPG_____L_I__ | | NNQRPSGVPD |
| | 13-7(A) | 1g | N_V_W___LPG_____L_I__ | | NNQRPSGVPD |
| | 13-7(A) | 1b | N_V_W___LPG_____L_I__ | | NNKRPSGIPD |
| VL2 | 14-7(A) | 2c | N_V_W___HPG_____M_I__ | | VSKRPSGVPD |
| | 14-7(A) | 2e | N_V_W___HPG_____M_I__ | | VSKRPSGVPD |
| | 14-7(A) | 2a2 | N_V_W___HPG_____M_I__ | | VSNRPSGVSN |
| | 14-7(A) | 2d | N_V_W___PPG_____M_I__ | | VSNRPSGVPD |
| | 14-7(A) | 2b2 | N_V_W___HPG_____M_I__ | | VSKRPSGVSN |
| VL3 | 11-7 | 3r | K_A_W___KPG_____V_I__ | | DSKRPSGIPE |
| | 11-7 | 3j | K_V_W___KPG_____V_I__ | | DSNRPSGIPE |
| | 11-7 | 3p | K_A_W___KSG_____V_I__ | | DSKRPSGIPE |
| | 11-7 | 3a | K_A_W___KPG_____V_I__ | | DSERPSGIPE |
| | 11-7 | 3l | Y_A_W___KPG_____V_I__ | | KNNRPSGIPD |
| | 11-7 | 3h | K_V_W___KPG_____V_I__ | | DSDRPSGIPE |
| | 11-7 | 3e | N_A_W___KPG_____V_I__ | | DSERYPGIPE |
| | 11-7 | 3m | Q_A_W___KPG_____V_I__ | | DSERPSGIPE |
| | 11-7 | 2-19 | K_A_W___KPG_____V_I__ | | DSERPSGIPE |
| VL4 | 12-11 | 4c | __I_W___QRPG_____IM__KS | | DGSHSKGDGIPD |
| | 12-11 | 4a | __I_W___QPG_____LM__EG | | SGSYNKGSGVPD |
| | 12-11 | 4b | __I_W___QPE_____LM__NS | | DGSHSKGDGIPD |
| VL5 | 14-11 | 5e | Y_I_W___KPG_____LL__YS | | DSDKGQGSGVPS |
| | 14-11 | 5c | Y_I_W___KPG_____LL__KS | | DSDKQQGSGVPS |
| | 14-11 | 5b | F_I_W___KPG_____LL__HS | | DSNKGQGSGVPS |
| VL6 | 13-7(B) | 6a | N_V_W___QRPG_____V_I__ | | DNQRPSGVPD |
| VL7 | 14-7(B) | 7a | Y_P_W___KPG_____L_I__ | | TSNKHSWTPA |
| | 14-7(B) | 7b | H_P_W___KPG_____L_I__ | | TSNKHSWTPA |
| VL8 | 14-7(B) | 8a | Y_P_W___TPG_____L_I__ | | TNTRSSGVPD |
| VL9 | 12-12 | 9a | __V_W___QRPG_____VM__GTG | | GIVGSKGDGIPD |
| VL10 | 13-7(C) | 10a | Q_A_W___HQG_____LS__ | | NNNRPSGISE |

FIGURE 7C

| | | | | | |
|---|---|---|---|---|---|
| VL1 | 13-7(A) | 1a | RFSGSKSG | TSASLAISGLQSEDEADY | ▓C▓▓▓▓DSLN |
| | 14-7(A) | 1e | RFSGSKSG | TSASLAITGLQAEDEADY | ▓C▓▓▓▓SSLS |
| | 13-7(A) | 1c | RFSGSKSG | TSASLAISGLQSEDEADY | ▓C▓▓▓▓DSLN |
| | 13-7(A) | 1g | RFSGSKSG | TSASLAISGLRSEDEADY | ▓C▓▓▓▓DSLS |
| | 13-7(A) | 1b | RFSGSKSG | TSATLGITGLQTGDEADY | ▓C▓▓▓▓SSLS |
| VL2 | 14-7(A) | 2c | RFSGSKSG | NTASLTVSGLQAEDEADY | ▓C▓▓▓▓GSNN |
| | 14-7(A) | 2e | RFSGSKSG | NTASLTISGLQAEDEADY | ▓C▓▓▓▓GSYT |
| | 14-7(A) | 2a2 | RFSGSKSG | NTASLTISGLQAEDEADY | ▓C▓▓▓▓SSST |
| | 14-7(A) | 2d | RFSGSKSG | NTASLTISGLQAEDEADY | ▓C▓▓▓▓SSST |
| | 14-7(A) | 2b2 | RFSGSKSG | NTASLTISGLQAEDEADY | ▓C▓▓▓▓GSST |
| VL3 | 11-7 | 3r | RFSGSNSG | NTATLTISGTQAMDEADY | ▓C▓▓▓▓SSTA |
| | 11-7 | 3j | RFSGSNSG | NTATLTISRAQAGDEADY | ▓C▓▓▓▓SSTA |
| | 11-7 | 3p | RFSGSSSG | TMATLTISGAQVEDEADY | ▓C▓▓▓▓SSGN |
| | 11-7 | 3a | RFSGSSSG | TIVTLTISGVQAEDEADY | ▓C▓▓▓▓SSGT |
| | 11-7 | 3l | RFSGSSSG | NTASLTITGAQAEDEADY | ▓C▓▓▓▓SSGN |
| | 11-7 | 3h | RFSGSNSG | NTATLTISRVEAGDEADY | ▓C▓▓▓▓SSSD |
| | 11-7 | 3e | RFSGSTSG | NTTTLTISRVLTEDEADY | ▓C▓▓▓▓EDN |
| | 11-7 | 3m | RFSGSSSG | TTVTLTISGVQAEDEADY | ▓C▓▓▓▓SSGT |
| | 11-7 | 2-19 | RFSGSSSG | TTVTLTISGAQVEDEADY | ▓C▓▓▓▓DNN |
| VL4 | 12-11 | 4c | RFMGSSSG | ADRYLTFSNLQSDDEAEY | ▓C▓▓▓▓TIDG |
| | 12-11 | 4a | RFSGSSSG | ADRYLTISNLQLEDEADY | ▓C▓▓▓▓SNT |
| | 12-11 | 4b | RFSGSSSG | AERYLTISSLQSEDEADY | ▓C▓▓▓▓TGI |
| VL5 | 14-11 | 5e | RFSGSKDASANTGILLISGLQSEDEADY | | ▓C▓▓▓▓SNAS |
| | 14-11 | 5c | RFSGSKDASANAGILLISGLQSEDEADY | | ▓C▓▓▓▓SSAS |
| | 14-11 | 5b | RFSGSNDASANAGILRISGLQPEDEADY | | ▓C▓▓▓▓SNSK |
| VL6 | 13-7(B) | 6a | RFSGSIDSSSNSASLTISGLKTEDEADY | | ▓C▓▓▓▓SSN |
| VL7 | 14-7(B) | 7a | RFSGSLLG | GKAALTLSGVQPEDEAEY | ▓C▓▓▓▓GGAQ |
| | 14-7(B) | 7b | RFSGSLLG | GKAALTLSGAQPEDEAEY | ▓C▓▓▓▓SGAR |
| VL8 | 14-7(B) | 8a | RFSGSILG | NKAALTITGAQADDESDY | ▓C▓▓▓▓GSGI |
| VL9 | 12-12 | 9a | RFSVLGSG | LNRYLTIKNIQEEDESDY | ▓C▓▓▓▓GSGS |
| VL10 | 13-7(C) | 10a | RLSASRSG | NTASLTITGLQPEDEADY | ▓C▓▓▓▓SSLS |

FIGURE 7D

| | | | |
|---|---|---|---|
| VL1 | 13-7(A) | 1a | ¹¹⁵G SEQ ID NO: 1136 |
| | 14-7(A) | 1e | ¹¹⁵G SEQ ID NO: 1137 |
| | 13-7(A) | 1c | ¹¹⁵G SEQ ID NO: 1138 |
| | 13-7(A) | 1g | ¹¹⁵G SEQ ID NO: 1139 |
| | 13-7(A) | 1b | A SEQ ID NO: 1140 |
| VL2 | 14-7(A) | 2c | F SEQ ID NO: 1141 |
| | 14-7(A) | 2e | ¹¹⁵F SEQ ID NO: 1142 |
| | 14-7(A) | 2a2 | ¹¹⁵L SEQ ID NO: 1143 |
| | 14-7(A) | 2d | F SEQ ID NO: 1144 |
| | 14-7(A) | 2b2 | ¹¹⁵F SEQ ID NO: 1145 |
| VL3 | 11-7 | 3r | SEQ ID NO: 1146 |
| | 11-7 | 3j | SEQ ID NO: 1147 |
| | 11-7 | 3p | ¹¹⁵H SEQ ID NO: 1148 |
| | 11-7 | 3a | ¹¹⁵Y SEQ ID NO: 1149 |
| | 11-7 | 3l | ¹¹⁶H SEQ ID NO: 1150 |
| | 11-7 | 3h | H SEQ ID NO: 1151 |
| | 11-7 | 3e | SEQ ID NO: 1152 |
| | 11-7 | 3m | ¹¹⁵Y SEQ ID NO: 1153 |
| | 11-7 | 2-19 | SEQ ID NO: 1154 |
| VL4 | 12-11 | 4c | ¹⁴⁰Q V SEQ ID NO: 1155 |
| | 12-11 | 4a | SEQ ID NO: 1156 |
| | 12-11 | 4b | SEQ ID NO: 1157 |
| VL5 | 14-11 | 5e | SEQ ID NO: 1158 |
| | 14-11 | 5c | SEQ ID NO: 1159 |
| | 14-11 | 5b | T SEQ ID NO: 1160 |
| VL6 | 13-7(B) | 6a | SEQ ID NO: 1161 |
| VL7 | 14-7(B) | 7a | SEQ ID NO: 1162 |
| | 14-7(B) | 7b | SEQ ID NO: 1163 |
| VL8 | 14-7(B) | 8a | SEQ ID NO: 1164 |
| VL9 | 12-12 | 9a | ¹¹⁵N F SEQ ID NO: 1165 |
| VL10 | 13-7(C) | 10a | A SEQ ID NO: 1166 |

FIGURE 7E

| | |
|---|---|
| JL1 | |
| JL2 | |
| JL3 | |
| JL3b | |
| JL7 | |

| | |
|---|---|
| JL1 | |
| JL2 | |
| JL3 | |
| JL3b | |
| JL7 | |

| | |
|---|---|
| JL1 | |
| JL2 | |
| JL3 | |
| JL3b | |
| JL7 | |

| | | SEQ ID NO |
|---|---|---|
| JL1 | TGTKVTVL | 1167 |
| JL2 | GGTKLTVL | 1168 |
| JL3 | GGTKLTVL | 1169 |
| JL3b | GGTKLTVL | 1170 |
| JL7 | GGTQLTVL | 1171 | ns

HETERODIMERIC IMMUNOGLOBULINS

CROSS-REFERENCE TO RELATED APPLICATIONS

The present application claims the benefit of priority to U.S. Provisional Application No. 61/729,148, filed Nov. 21, 2012 and U.S. Provisional Application No. 61/779,439, filed Mar. 13, 2013, the disclosures of which are incorporated herein by reference in their entireties.

TECHNICAL FIELD OF THE INVENTION

The invention generally relates to methods of making and using heterodimeric antibodies for the treatment of disorders associated with low bone mineral density.

INCORPORATION BY REFERENCE OF MATERIAL SUBMITTED ELECTRONICALLY

Incorporated by reference in its entirety is a computer-readable nucleotide/amino acid sequence listing submitted concurrently herewith and identified as follows: ASCII (text) file named "47233B_SubSeqlisting.txt," 962,616 bytes, created on Aug. 20,2015.

INCORPORATION BY REFERENCE

The following applications are hereby incorporated by reference in their entirety: PCT/US2012/049331, filed Aug. 2, 2012, which claims priority to U.S. Provisional Patent Application No. 61/515,191, filed Aug. 4, 2011; U.S. patent application Ser. No. 11/410,540, filed Apr. 25, 2006 (issued as U.S. Pat. No. 8,003,108), which claims priority to U.S. Provisional Patent Application No. 60/792,645, filed Apr. 17, 2006, U.S. Provisional Patent Application No. 60/782,244, filed Mar. 13, 2006, U.S. Provisional Patent Application No. 60/776,847, filed Feb. 24, 2006, and U.S. Provisional Patent Application No. 60/677,583, filed May 3, 2005; and U.S. patent application Ser. No. 11/411,003 (issued as U.S. Pat. No. 7,592,429), filed Apr. 25, 2006, which claims priority to U.S. Provisional patent application Ser. No. 60/792,645, filed Apr. 17, 2006, U.S. Provisional Patent Application No. 60/782,244, filed Mar. 13, 2006, U.S. Provisional Patent Application No. 60/776,847, filed Feb. 24, 2006, and U.S. Provisional Patent Application No. 60/677,583, filed May 3, 2005. The following applications also are hereby incorporated by reference: U.S. patent application Ser. No. 12/212,327, filed Sep. 17, 2008, which claims priority to U.S. Provisional Patent Application No. 60/973,024, filed Sep. 17, 2007; and U.S. pat. application Ser. No 12/811,171, filed Jun. 29, 2010, (now abandoned) which is a U.S. National Phase Application pursuant to 35 U.S.C. § 371 of International Patent Application No. PCT/US08/86864, filed on Dec. 15, 2008, which claims priority to U.S. Provisional Patent Application No. 61/013,917, filed Dec. 14, 2007.

BACKGROUND OF THE INVENTION

The development of bispecific antibodies as therapeutic agents for human diseases has great clinical potential. Bispecific antibodies can simultaneously recognize two different antigens, neutralize different pathogenic mediators, recruit different type of effector cells, and modulate signal pathways. However, production of bispecific antibodies has been very challenging. The broad application of bispecific antibodies has been hindered by the difficulties of developing a platform for producing bispecific antibodies that exhibit favorable half-life, high stability, lack of immunogenicity, and feasibilities for large scale manufacturing and purification. Promising bispecific antibodies formats such as DVD-Ig (Dual Variable Domain Ig) (Nature Biotechnology 25, 1290-1297 (2007)); Cross-over Ig [Schaefer W et al (2011) PNAS 108(27): 11187-11192]; Two-in-One Ig (Science 2009, 323, 1610); BiTE® antibodies [PNAS 92(15):7021-7025; 1995] allow the production of a bispecific antibody, but they do have different kinds of liabilities.

SUMMARY OF THE INVENTION

Described herein are methods of generating heterodimeric antibodies from two different preexisting antibodies.

In one aspect, described herein is a heterodimeric antibody or fragment thereof comprising one or more substitutions in each of the following domains: a first $CH_3$-domain, a second $CH_3$-domain, a $CH_1$-domain, a $C_L$-domain, a $V_H$-domain and a $V_L$-domain, wherein the one or more substitutions introduce charged amino acids that are electrostatically unfavorable to homodimer formation and electrostatically favorable to heterodimer formation.

In some variations, the first CH3-domain or the second CH3-domain comprises an amino acid sequence differing from wild-type IgG amino acid sequence such that one or more positive-charged amino acids (e.g., lysine, histidine and arginine) in the wild-type human IgG amino acid sequence are replaced with one or more negative-charged amino acids (e.g., aspartic acid and glutamic acid) at the corresponding position(s) in the CH3 domain. Alternatively, the first CH3-domain or the second CH3-domain comprises an amino acid sequence differing from wild-type IgG amino acid sequence such that one or more negative-charged amino acids in the wild-type human IgG amino acid sequence are replaced with one or more positive-charged amino acids at the corresponding position(s) in the CH3 domain.

In some variations, the CH1-domain or the CL-domain comprises an amino acid sequence differing from wild-type IgG amino acid sequence such that one or more positive-charged amino acids in wild-type IgG amino acid sequence are replaced with one or more negative-charged amino acids. Alternatively, the CH1-domain or the CL-domain comprises an amino acid sequence differing from wild-type IgG amino acid sequence such that one or more negative-charged amino acids in wild-type IgG amino acid sequence are replaced with one or more positive-charged amino acids.

The VH-domain or the VL-domain of a heterodimeric antibody described herein comprises, in some variations, an amino acid sequence differing from wild-type IgG amino acid sequence such that one or more positive-charged amino acids in wild-type IgG amino acid sequence are replaced with one or more negative-charged amino acids. Alternatively, the VH-domain or the VL-domain comprises an amino acid sequence differing from wild-type IgG amino acid sequence such that one or more negative-charged amino acids in wild-type IgG amino acid sequence are replaced with one or more positive-charged amino acids.

In another aspect, described herein is a heterodimeric antibody or fragment thereof comprising a heavy chain comprising (a) a first amino acid substitution at an AHo position selected from the group consisting of AHo positions 42-50 that introduces a charged amino acid at said position, (b) a second amino acid substitution at a position selected from the group consisting of positions 126-213 (EU numbering) that introduces a charged amino acid at said position, (c) a third amino acid substitution at a position selected from the group consisting of positions 352-360 (EU numbering) that introduces a charged amino acid at said position, and (d) a fourth amino acid substitution at a position selected from the group consisting of positions 395-403 (EU numbering) that introduces a charged amino acid, wherein the charged amino acid of (a) has the same charge as the charged amino acid of (b), and wherein the charged amino acids of (c) and (d) have an opposite charge of the charged amino acids of (a) and (b).

In some embodiments, the first amino acid substitution is at AHo position 46, the second amino acid substitution is at EU position 183, the third amino acid substitution is at EU position 356 and the fourth amino acid substitution is at EU position 399. In some embodiments, glutamine at AHo position 46 is replaced with glutamic acid, serine at EU position 183 is replaced with glutamic acid, glutamic acid at EU position 356 is replaced with lysine, and aspartic acid at EU position 399 is replaced with lysine.

In another aspect, described herein is an antibody or fragment thereof comprising a heavy chain comprising (a) a first amino acid substitution at an AHo position selected from the group consisting of AHo positions 35-43 that introduces a charged amino acid at said position, (b) a second amino acid substitution at a position selected from the group consisting of positions 126-213 (EU numbering) that introduces a charged amino acid at said position, (c) a third amino acid substitution at a position selected from the group consisting of positions 388-398 (EU numbering) that introduces a charged amino acid at said position, and (d) a fourth amino acid substitution at a position selected from the group consisting of positions 404-413 (EU numbering) that introduces a charged amino acid, wherein the charged amino acids of (c) and (d) have an opposite charge of the charged amino acids of (a) and (b). In some embodiments, the glutamine at AHo position 46 is replaced with lysine, serine at EU position 183 is replaced with lysine, lysine at EU position 392 is replaced with aspartic acid and lysine at EU position 409 is replaced with aspartic acid.

In yet another aspect, described herein is an antibody or fragment comprising a light chain comprising (a) a first amino acid substitution at an AHo position selected from the group consisting of AHo positions 42-50 that introduces a charged amino acid at said position, and (b) a second amino acid substitution at a position selected from the group consisting of positions 126-213 (EU numbering) that introduces a charged amino acid at said position. In some embodiments, glutamine at AHo position 46 is replaced with glutamic acid and serine at EU position 176 is replaced with glutamic acid.

In another aspect, described herein is an antibody comprising a heavy chain comprising (a) a first amino acid substitution at an AHo position selected from the group consisting of AHo positions 42-50 that introduces a charged amino acid at said position, (b) a second amino acid substitution at a position selected from the group consisting of positions 126-213 (EU numbering) that introduces a charged amino acid at said position, (c) a third amino acid substitution at a position selected from the group consisting of positions 352-360 (EU numbering) that introduces a charged amino acid at said position, and (d) a fourth amino acid substitution at a position selected from the group consisting of positions 395-403 (EU numbering) that introduces a charged amino acid, wherein the charged amino acids of (a) and (b) have a negative-charge and the charged amino acids of (c) and (d) have a positive charge. In some embodiments, the first amino acid substitution is at position AHo 46, the second amino acid substitution is at EU position 183, the third amino acid substitution is at EU position 356 and the fourth amino acid substitution is at EU position 399. In some embodiments, the antibody comprises a light chain comprising positive-charged amino acids at AHo position 46 and EU position 176.

In still another aspect, described herein is a heterodimeric antibody comprising a first heavy chain and a second heavy chain and a first light chain and a second light chain, wherein the first heavy chain comprises amino acid substitutions at AHo position 46 and EU positions 183, 356 and 399, wherein the second heavy chain comprises amino acid substitutions at AHo position 46 and EU positions 183, 392 and 409, and wherein the first and second light chains comprise an amino acid substitution at AHo position 46 and EU position 176, wherein the amino acid substitutions introduce a charged amino acid at said positions. In some embodiments, the glutamine at position AHo 46 of the first heavy chain is replaced with glutamic acid, the glutamine at position AHo 46 of the second heavy chain is replaced with lysine, the glutamine at position AHo 46 of the first light chain is replaced with lysine, the glutamine at position AHo 46 of the second light chain is replaced with glutamic acid, the serine at EU position 183 of the first heavy chain is replaced with glutamic acid, the glutamic acid at EU position 356 of the first heavy chain is replaced with lysine, the glutamic acid at EU position 399 of the first heavy chain is replaced with lysine, the serine at EU position 183 of the second heavy chain is replaced with lysine, the lysine at EU position 392 of the second heavy chain is replaced with aspartic acid, and the lysine at EU position 409 of the second heavy chain is replaced with aspartic acid.

In some or any of the embodiments described herein, the antibody binds to a region of sclerostin comprising amino acids 86-111 of SEQ ID NO: 1.

Also described herein is a heterodimeric antibody that binds to a region of sclerostin comprising amino acids 86-111 of SEQ ID NO: 1, wherein the antibody comprises a first heavy chain and a first light chain comprising a sclerostin-binding portion and a second heavy chain and a second light chain comprising a DKK1-binding portion, wherein the first heavy chain comprises amino acid substitutions at AHo position 46 and EU positions 183, 356 and 399, wherein the second heavy chain comprises amino acid substitutions at AHo position 46 and EU positions 183, 392 and 409, wherein the first and second light chains comprise an amino acid substitution at AHo position 46 and EU position 176, and wherein the amino acid substitutions introduce a charged amino acid at said positions.

In yet another aspect, described herein is a heterodimeric antibody that binds to a region of sclerostin comprising amino acids 86-111 of SEQ ID NO: 1, the antibody comprising a first heavy chain and a first light chain comprising a sclerostin-binding portion and a second heavy chain and a second light chain comprising a DKK1-binding portion, wherein the first heavy chain comprises amino acid substitutions at EU positions 183, 356 and 399, wherein the second heavy chain comprises amino acid substitutions at EU positions 183, 392 and 409, and wherein the first and second light chains comprise an amino acid substitution at EU position 176, wherein the amino acid substitutions introduce a charged amino acid at said positions.

Another aspect of the invention relates to a heterodimeric antibody that binds sclerostin and DKK-1, comprising a first heavy chain comprising a heavy chain variable region amino acid sequence of any one of the sclerostin antibodies described herein and comprising amino acid substitutions at EU positions 183, 356 and 399 of the first heavy chain, a second heavy chain comprising a heavy chain variable region amino acid sequence of any one of the DKK-1 antibodies described herein and comprising amino acid substitutions at EU positions 183, 392 and 409 of the second heavy chain, a first light chain comprising a light chain variable region amino acid sequence of any one of the sclerostin antibodies described herein and comprising an amino acid substitution at EU position 176 of the first light chain, and a second light chain comprising a light chain variable region amino acid sequence of any of the DKK-1 antibodies described herein and comprising an amino acid substitution at EU position 176 of the second light chain; wherein the amino acid substitutions introduce a charged amino acid at said positions.

Another aspect of the invention relates to a heterodimeric antibody that binds sclerostin and DKK-1, comprising a first heavy chain comprising a variable region amino acid sequence selected from the group consisting of SEQ ID NOs: 378 and 366 and comprising amino acid substitutions at EU positions 183, 356 and 399 of the first heavy chain, a second heavy chain comprising a variable region amino acid sequence selected from the group consisting of SEQ ID NOs: 1003 and 974 and comprising amino acid substitutions at EU positions 183, 392 and 409 of the second heavy chain, a first light chain comprising a variable region amino acid sequence selected from the group consisting of SEQ ID NOs: 376 and 364 and comprising an amino acid substitution at EU position 176 of the first light chain, and a second light chain comprising a variable region amino acid sequence selected from the group consisting of SEQ ID NOs: 1002 and 978 and comprising an amino acid substitution at EU position 176 of the second light chain; wherein the amino acid substitutions introduce a charged amino acid at said positions.

In some embodiments, the heterodimeric antibody that binds sclerostin and DKK1 comprises a first heavy chain comprising the amino acid sequence set forth in SEQ ID NO: 1038; a second heavy chain comprising the amino acid sequence set forth in SEQ ID NO: 1034; a first light chain comprising the amino acid sequence set forth in SEQ ID NO: 1039 and a second light chain comprising the amino acid sequence set forth in SEQ ID NO: 1035.

In some embodiments, the heterodimeric antibody that binds sclerostin and DKK1 comprises a first heavy chain comprising the amino acid sequence set forth in SEQ ID NO: 1038; a second heavy chain comprising the amino acid sequence set forth in SEQ ID NO: 1036; a first light chain comprising the amino acid sequence set forth in SEQ ID NO: 1039 and a second light chain comprising the amino acid sequence set forth in SEQ ID NO: 1037.

In some embodiments, the heterodimeric antibody that binds sclerostin and DKK1 comprises a first heavy chain comprising the amino acid sequence set forth in SEQ ID NO: 1040; a second heavy chain comprising the amino acid sequence set forth in SEQ ID NO: 1034; a first light chain comprising the amino acid sequence set forth in SEQ ID NO: 1041 and a second light chain comprising the amino acid sequence set forth in SEQ ID NO: 1035.

In some embodiments, the heterodimeric antibody that binds sclerostin and DKK1 comprises a first heavy chain comprising the amino acid sequence set forth in SEQ ID NO: 1040; a second heavy chain comprising the amino acid sequence set forth in SEQ ID NO: 1036; a first light chain comprising the amino acid sequence set forth in SEQ ID NO: 1041 and a second light chain comprising the amino acid sequence set forth in SEQ ID NO: 1037.

In some embodiments, the heterodimeric antibody that binds sclerostin and DKK1 comprises a first heavy chain comprising the amino acid sequence set forth in SEQ ID NO: 1046; a second heavy chain comprising the amino acid sequence set forth in SEQ ID NO: 1042; a first light chain comprising the amino acid sequence set forth in SEQ ID NO: 1047 and a second light chain comprising the amino acid sequence set forth in SEQ ID NO: 1043.

In some embodiments, the heterodimeric antibody that binds sclerostin and DKK1 comprises a first heavy chain comprising the amino acid sequence set forth in SEQ ID NO: 1046; a second heavy chain comprising the amino acid sequence set forth in SEQ ID NO: 1044; a first light chain comprising the amino acid sequence set forth in SEQ ID NO: 1047 and a second light chain comprising the amino acid sequence set forth in SEQ ID NO: 1045.

In some embodiments, the heterodimeric antibody that binds sclerostin and DKK1 comprises a first heavy chain comprising the amino acid sequence set forth in SEQ ID NO: 1048; a second heavy chain comprising the amino acid sequence set forth in SEQ ID NO: 1042; a first light chain comprising the amino acid sequence set forth in SEQ ID NO: 1049 and a second light chain comprising the amino acid sequence set forth in SEQ ID NO: 1043.

In some embodiments, the heterodimeric antibody that binds sclerostin and DKK1 comprises a first heavy chain comprising the amino acid sequence set forth in SEQ ID NO: 1048; a second heavy chain comprising the amino acid sequence set forth in SEQ ID NO: 1044; a first light chain comprising the amino acid sequence set forth in SEQ ID NO: 1049 and a second light chain comprising the amino acid sequence set forth in SEQ ID NO: 1045.

The invention also contemplates a heterodimeric antibody comprising a heavy chain that comprises an amino acid sequence selected from the group consisting of SEQ ID NO: 1038, SEQ ID NO: 1046, SEQ ID NO: 1040 and SEQ ID NO: 1048. In some embodiments, the heterodimeric antibody optionally comprises a light chain amino acid sequence selected from the group consisting of SEQ ID NO: 1039, SEQ ID NO: 1047, SEQ ID NO: 1041 and SEQ ID NO: 1049.

The invention also contemplates a heterodimeric antibody comprising a heavy chain that comprises an amino acid sequence selected from the group consisting of SEQ ID NO: 1034, SEQ ID NO: 1042, SEQ ID NO: 1036 and SEQ ID NO: 1044. In some embodiments, the heterodimeric antibody optionally comprises a light chain amino acid sequence selected from the group consisting of SEQ ID NO: 1035, SEQ ID NO: 1043, SEQ ID NO: 1037 and SEQ ID NO: 1045.

In another aspect, described herein is an antibody that binds to a region of sclerostin comprising amino acids 86-111 of SEQ ID NO: 1, wherein the antibody comprises substitutions in each of the following domains: a first CH3-domain, a second CH3-domain, a CH1-domain, and a CL-domain, wherein the one or more substitutions introduce charged amino acids that are electrostatically unfavorable to homodimer formation and electrostatically favorable to heterodimer formation.

Also described herein is an antibody that binds to a region of sclerostin comprising amino acids 86-111 of SEQ ID NO: 1, wherein the antibody comprises a heavy chain having a CH3 domain comprising one or more amino acid substitutions, wherein the one or more substitutions introduce charged amino acids that are electrostatically unfavorable to homodimer formation and electrostatically favorable to heterodimer formation. In some embodiments, a negative charged amino acid in the CH3 domain (e.g., at EU position D399, E356 or E357) is substituted with a positive charged amino acid. In some embodiments, amino acids at EU positions D399, E356 and E357 are substituted with a positive charged amino acid (e.g., lysine).

In alternative embodiments, a positive charged amino acid in the CH3 domain (e.g., at EU position K370, K392 or K409) is substituted with a negative charged amino acid. In some embodiments, amino acids as EU positions K370, K392 and K409 are substituted with a negative charged amino acid (e.g., aspartic acid).

The heterodimeric antibody is, in some embodiments, an antibody, a bispecific antibody, a monospecific monovalent antibody, a bispecific maxibody, a monobody, a peptibody, a bispecific peptibody, a monovalent peptibody or a receptor fusion protein.

Nucleic acids comprising a nucleotide sequence encoding any of the heterodimeric antibodies described herein are also provided, as well as vectors and host cells comprising the nucleic acid (or vector).

Another aspect of the invention relates to method of increasing bone mineral density in a mammalian subject comprising administering a heterodimeric antibody described herein to the subject in an amount effective to increase bone mineral density in the subject. The invention also includes methods of using heterodimeric antibodies described herein for increasing bone mineral density. Methods of using as described herein can alternatively be characterized as uses of the heterodimeric antibodies for increasing bone mineral density.

The invention also includes compositions comprising a heterodimeric antibody described herein and a pharmaceutically acceptable carrier, diluent or adjuvant. In some embodiments, less than 5% (or less than 4%, or less than 3%, or less than 2% or less than 1% or less) of the antibody in the composition is in aggregate form after two weeks of storage at about 4° C. The amount of antibody aggregation in the composition can be determined, for example, by Size Seclusion Chromatography (SEC) or Dynamic Light Scattering (DLS).

In another aspect, described herein is a composition comprising a heterodimeric antibody or fragment thereof and a pharmaceutically acceptable carrier, diluent or adjuvant, the heterodimeric antibody or fragment thereof comprising one or more substitutions in each of the following domains: a first $CH_3$-domain, a second $CH_3$-domain, a $CH_1$-domain, a $C_L$-domain, a $V_H$-domain and a $V_L$-domain, wherein the one or more substitutions introduce charged amino acids that are electrostatically unfavorable to homodimer formation and electrostatically favorable to heterodimer formation; wherein less than 5% of the antibody or fragment in the composition is in aggregate form after two weeks of storage at about 4° C.

In another aspect, described herein is a composition comprising a heterodimeric antibody that binds to a region of sclerostin comprising amino acids 86-111 of SEQ ID NO: 1 and a pharmaceutically acceptable carrier, diluent or adjuvant, the antibody comprising substitutions in each of the following domains: a first $CH_3$-domain, a second $CH_3$-domain, a $CH_1$-domain, and a $C_L$-domain, wherein the one or more substitutions introduce charged amino acids that are electrostatically unfavorable to homodimer formation and electrostatically favorable to heterodimer formation; wherein less than 5% of the antibody in the composition is in aggregate form after two weeks of storage at about 4° C.

The section headings used herein are for organizational purposes only and are not to be construed as limiting the subject matter described. All references cited within the body of this specification are expressly incorporated by reference in their entirety.

Standard techniques may be used for recombinant DNA, oligonucleotide synthesis, tissue culture and transformation, protein purification, etc. Enzymatic reactions and purification techniques may be performed according to the manufacturer's specifications or as commonly accomplished in the art or as described herein. The following procedures and techniques may be generally performed according to conventional methods well known in the art and as described in various general and more specific references that are cited and discussed throughout the specification. See, e.g., Sambrook et al., 2001, Molecular Cloning: A Laboratory Manuel, 3rd ed., Cold Spring Harbor Laboratory Press, cold Spring Harbor, N.Y., which is incorporated herein by reference for any purpose. Unless specific definitions are provided, the nomenclature used in connection with, and the laboratory procedures and techniques of, analytic chemistry, organic chemistry, and medicinal and pharmaceutical chemistry described herein are those well known and commonly used in the art. Standard techniques may be used for chemical synthesis, chemical analyses, pharmaceutical preparation, formulation, and delivery and treatment of patients.

BRIEF DESCRIPTION OF THE FIGURES

FIG. 4: Configurations of bispecific antibody variants using different approaches (a) A pair of charged residues K/D in variable regions binding to antigen A combined with a pair of charged residues D/K in $C_H1$/CL to enforce the LC to pair with its cognate HC; A pair of charged residues D/K in variable regions binding to antigen B combined with a pair of charged residues K/D in $C_H1$/CL to enforce the LC to pair with its cognate HC. The heterodimerizing charge residues in $C_H3$ domains are also indicated. (b) A pair of charged residues D/K in variable regions binding to antigen A combined with two pairs of charged residues KK/DD in $C_H1$/CL to enforce the LC to pair with its cognate HC; A pair of charged residues K/D in variable regions binding to antigen B combined with two pairs of charged residues DD/KK in $C_H1$/CL to enforce the LC to pair with its cognate HC. The charge residues for heterodimerization in $C_H3$ domains are also indicated. (c) Two pairs of charged residues KK/DD in variable regions binding to antigen A combined with one pair of charged residues D/K in $C_H1$/CL to enforce the LC to pair with its cognate HC; two pairs of charged residues DD/KK in variable regions binding to antigen B combined with one pair of charged residues K/D in $C_H1$/CL to enforce the LC to pair with its cognate HC. The charge residues for heterodimerization in $C_H3$ domains are also indicated. (d) Two pairs of charged residues KK/DD in variable regions binding to antigen A combined with two pairs of charged residues DD/KK in $C_H1$/CL to enforce the LC to pair with its cognate HC; two pairs of charged residues DD/KK in variable regions binding to antigen B combined with two pair of charged residues KK/DD in $C_H1$/CL to enforce the LC to pair with its cognate HC. The charge residues for heterodimerization in $C_H3$ domains are also indicated. (e) One pair of charged residues K/D and one pair of cysteine residues in variable regions binding to antigen A combined with one pair of charged residues D/K in $C_H1$/CL to enforce the LC to pair with its cognate HC; One pair of cysteine residues and one pair of charged residues D/K in variable regions binding to antigen B combined with one pair of charged residues K/D in $C_H1$/CL to enforce the LC to pair with its cognate HC. The charge residues for heterodimerization in $C_H3$ domains are also indicated. © represents the cysteine residue, a disulfide bond formed between two cysteine residues could stabilize the Fab region with correct LC/HC pairing. (f) One pair of charged residues K/D and one pair of small/bulky residues in variable regions binding to antigen A combined with one pair of charged residues D/K in $C_H1$/CL to enforce the LC to pair with its cognate HC; one pair of charged residues D/K and one pair of bulky/small residues and in variable regions binding to antigen B combined with one pair of charged residues K/D in $C_H1$/CL to enforce the LC to pair with its cognate HC. The charge residues for heterodimerization in $C_H3$ domains are also indicated. Protrusive triangle represents the bulky residue; recessive triangle represents the small residue. A knob-into-hole effect may work cooperatively with electrostatic steering effect to guide and stabilize the correct LC/HC pairing.

FIGS. 5A-5D: Alignment of human heavy chain V and J regions. Numbering is based on the AHo system. Interface residues are highlighted.

FIGS. 6A-6D: Alignment of human kappa chain V and J regions. Numbering is based on the AHo system. Interface residues are highlighted.

FIGS. 7A-7E: Alignment of human lambda chain V and J regions. Numbering is based on the AHo system. Interface residues are highlighted.

DETAILED DESCRIPTION OF THE INVENTION

Figure 1:
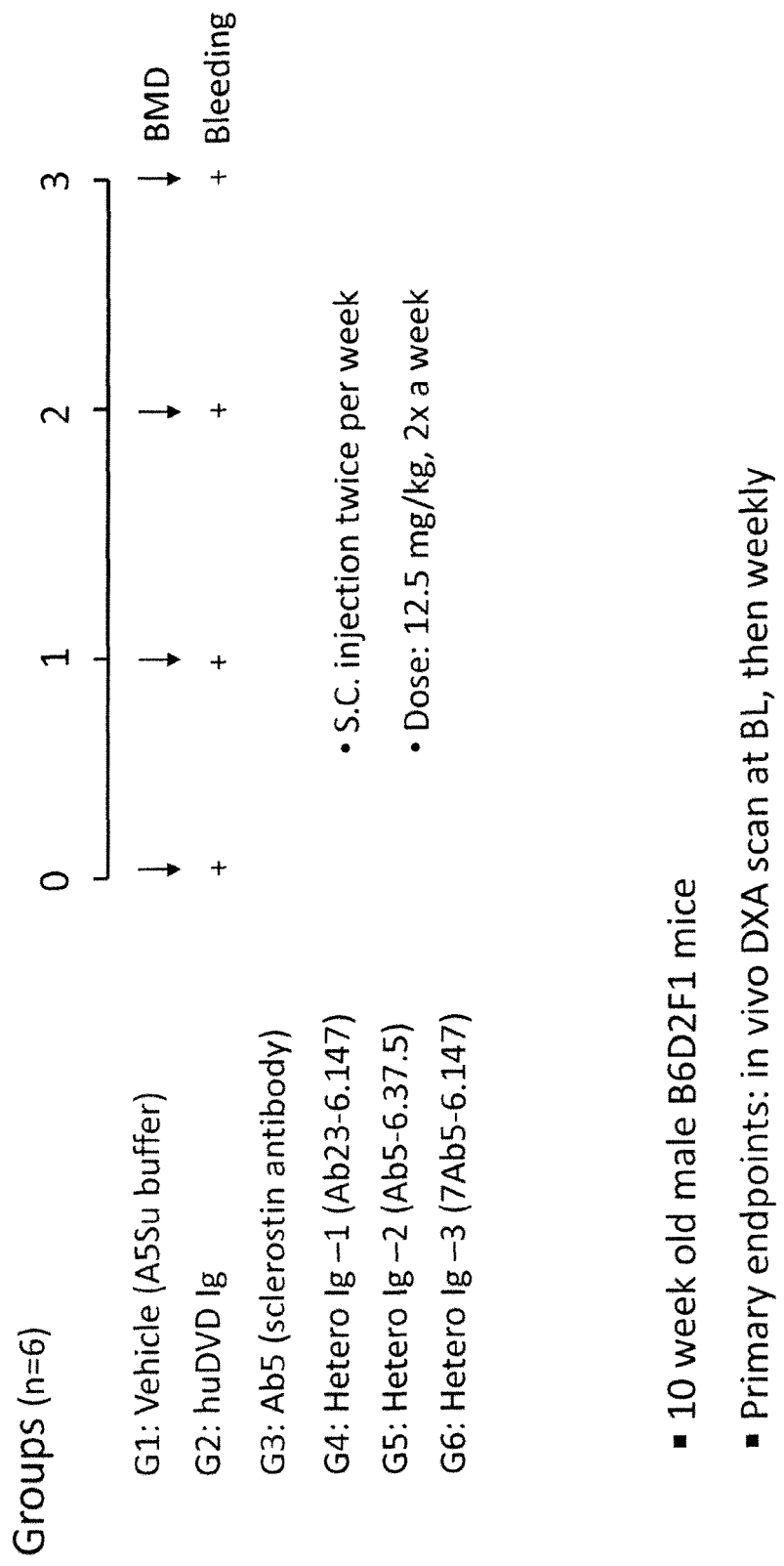
FIG. 1 illustrates the in vivo study design for the following heterodimeric antibodies: (1) Ab23-Ab6.147 v2, (2) Ab5-Ab6.37.5 v1, and (3) Ab5-Ab6.147.

The present application is based on the discovery that heterodimeric IgGs could be produced by engineering the heavy chain and light chain of the two different antibodies in such a way that they can assemble exclusively into a heterodimeric antibody without other contaminating species. In one aspect, heterodimeric pairing is achieved by engineering the CH3 regions of two heavy chains so that it forms a heterodimer exclusively. Further, electrostatic steering achieved by engineering interface residues between the light chains (LC) and the heavy chains (HC) prevents mis-pairing of light chains to the non-cognate heavy chains when two different heavy chain and light chain pairs are assembling to form a desired four-chain heterodimeric antibody. As described herein, an exemplary strategy comprises introducing one or more negatively-charged residues (e.g., Asp or Glu) in a first light chain (LC1) and one or more positively-charged residues (e.g., Lys, His or Arg) in the companion heavy chain (HC1) at the LC1/HC1 interface while introducing one or more positively-charged residues (e.g., Lys, His or Arg) in a second light chain (LC2) and one or more negatively-charged residues (e.g., Asp or Glu) in the companion heavy chain (HC2) at the LC2/HC2 interface. The electrostatic steering effect directs the LC1 to pair with HC1 and LC2 to pair with HC2, as the opposite charged residues (polarity) at the interface attract, while the same type of charged residues (polarity) at an interface causes repulsion, resulting in suppression of the unwanted HC/LC pairings.

The LC/HC interface residues selected for engineering are buried and spatially close within the VL/VH and CL/CH1 interfaces. The target residues are well conserved among different antibody families. Other ways of engineering the light and heavy chains to form specific heterodimers include replacing one pair of charged residues in the VL/VH interface with a pair of cysteine residues to form a disulfide bond to stabilize the Fab region, replacing one or more hydrophilic residues (e.g., glycine) in the VL/VH interface with a hydrophobic residue (e.g., glutamine), or engineering a pair of bulky/small residues at the VL/VH interface to exert a knob-into-hole effect to accommodate the correct LC/HC pairing. The strategy described herein can be used to efficiently produce a full-length heterodimeric antibody from two preexisting antibodies without using artificial linkers.

The resulting heterodimeric antibodies are stable and amenable to commercial manufacturing without excessive aggregation or loss of yield. Because this new version of heterodimeric antibody can target two different antigens or two different epitopes on the same antigen simultaneously, it may have significant potential to uniquely treat many diseases.

The term "interface" as used herein refers to the association surface that results from interaction one or more amino acids in a first antibody domain with one or more amino acids of a second antibody domain. Exemplary interfaces include, CH1/CL, VH/VL and CH3/CH3. In some embodiments, the interface includes, for example, hydrogen bonds, electrostatic interactions, or salt bridges between the amino acids forming an interface.

In one aspect, described herein is a heterodimeric antibody or fragment thereof comprising one or more substitutions in each of the following domains: a first $CH_3$-domain, a second $CH_3$-domain, a $CH_1$-domain, a $C_L$-domain, a $V_H$-domain and a $V_L$-domain, wherein the one or more substitutions introduce charged amino acids that are electrostatically unfavorable to homodimer formation and electrostatically favorable to heterodimer formation.

Heterodimeric antibodies described herein can comprise any constant region. The light chain constant region can be, for example, a kappa- or lambda-type light chain constant region, e.g., a human kappa- or lambda-type light chain constant region. The heavy chain constant region can be, for example, an alpha-, delta-, epsilon-, gamma-, or mu-type heavy chain constant region, e.g., a human alpha-, delta-, epsilon-, gamma-, or mu-type heavy chain constant region. In one embodiment the light or heavy chain constant region is a fragment, derivative, variant, or mutein of a naturally-occurring constant region.

In some variations, the first CH3-domain or the second CH3-domain comprises an amino acid sequence differing from wild-type IgG amino acid sequence such that one or more positive-charged amino acids (e.g., lysine, histidine and arginine) in the wild-type human IgG amino acid sequence are replaced with one or more negative-charged amino acids (e.g., aspartic acid and glutamic acid) at the corresponding position(s) in the CH3 domain. Alternatively, the first CH3-domain or the second CH3-domain comprises an amino acid sequence differing from wild-type IgG amino acid sequence such that one or more negative-charged amino acids in the wild-type human IgG amino acid sequence are replaced with one or more positive-charged amino acids at the corresponding position(s) in the CH3 domain.

In some variations, the CH1-domain or the CL-domain comprises an amino acid sequence differing from wild-type IgG amino acid sequence such that one or more positive-charged amino acids in wild-type IgG amino acid sequence are replaced with one or more negative-charged amino acids. Alternatively, the CH1-domain or the CL-domain comprises an amino acid sequence differing from wild-type IgG amino acid sequence such that one or more negative-charged amino acids in wild-type IgG amino acid sequence are replaced with one or more positive-charged amino acids.

The VH-domain or the VL-domain of a heterodimeric antibody described herein comprises, in some variations, an amino acid sequence differing from wild-type IgG amino acid sequence such that one or more positive-charged amino acids in wild-type IgG amino acid sequence are replaced with one or more negative-charged amino acids. Alternatively, the VH-domain or the VL-domain comprises an amino acid sequence differing from wild-type IgG amino acid sequence such that one or more negative-charged amino acids in wild-type IgG amino acid sequence are replaced with one or more positive-charged amino acids.

In another aspect, described herein is a heterodimeric antibody or fragment thereof comprising a heavy chain comprising (a) a first amino acid substitution at an AHo position selected from the group consisting of AHo positions 42-50 that introduces a charged amino acid at said position, (b) a second amino acid substitution at a position selected from the group consisting of positions 126-213 (EU numbering) that introduces a charged amino acid at said position, (c) a third amino acid substitution at a position selected from the group consisting of positions 352-360 (EU numbering) that introduces a charged amino acid at said position, and (d) a fourth amino acid substitution at a position selected from the group consisting of positions 395-403 (EU numbering) that introduces a charged amino acid, wherein the charged amino acid of (a) has the same charge as the charged amino acid of (b), and wherein the charged amino acids of (c) and (d) have an opposite charge of the charged amino acids of (a) and (b).

Figure 5D:
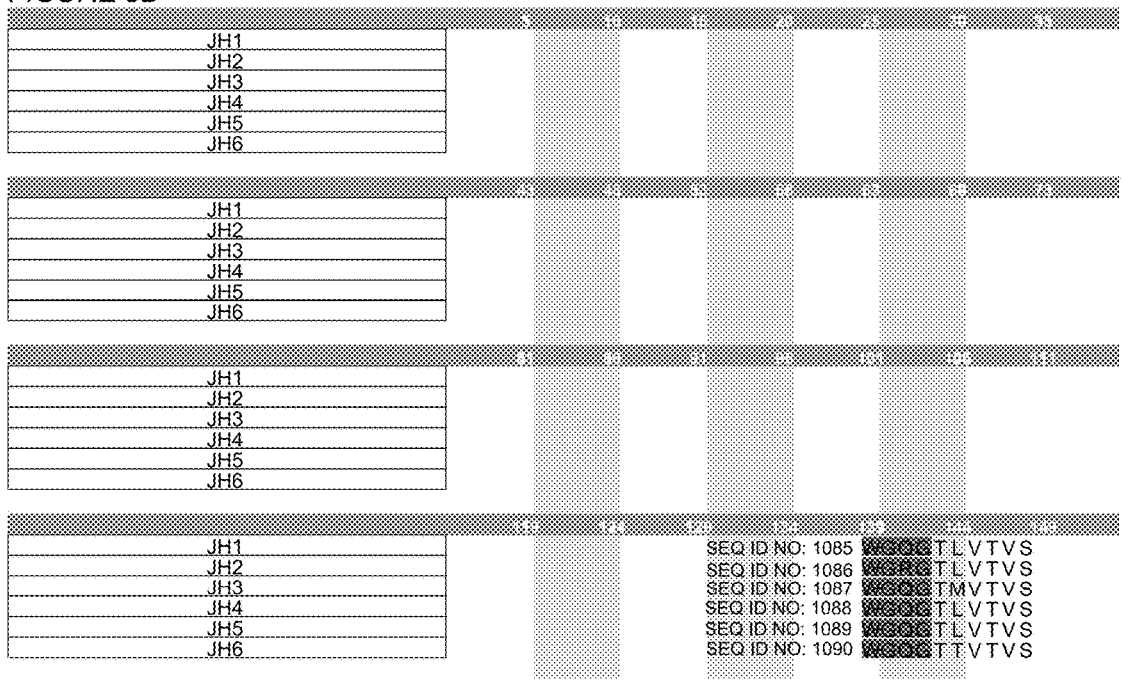
Figure 6D:
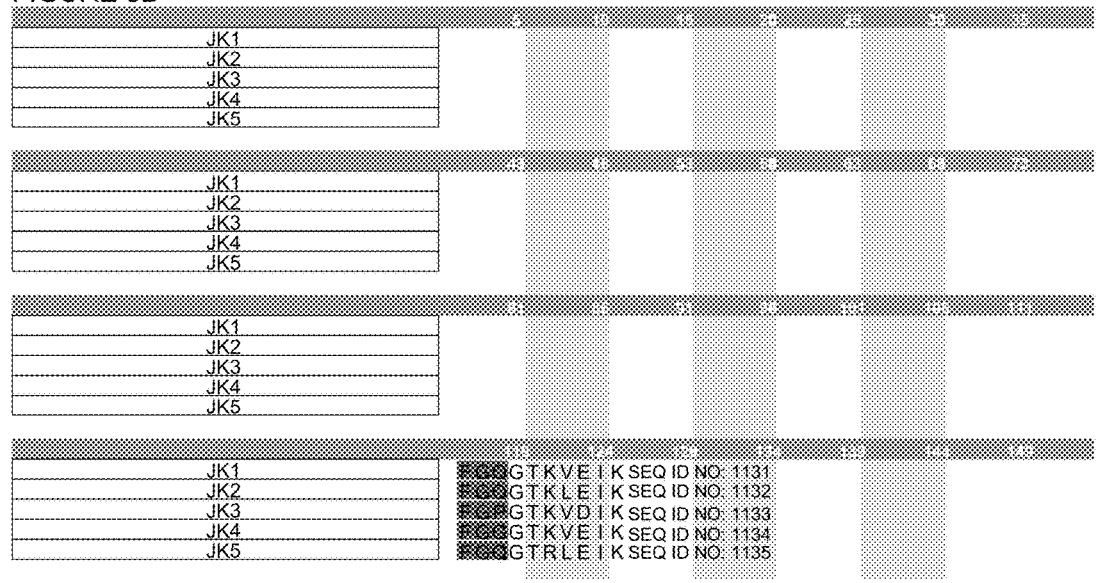

Herein, the position of particular amino acids within the framework regions of the variable domains (described below) is described using the AHo numbering system. Because antibody CDR amino acid sequence length varies from antibody to antibody, numbering residues based on the linear sequence (assuming the first residue as position 1) leads to framework residues having different position numbers between antibodies. Using Kabat or EU numbering scheme could avoid this conflict and enable comparison of framework positions across antibodies. However, structurally equivalent positions can have a different Kabat or EU number. Similarly, residues having same Kabat number can be present at two different locations on the structure. Annemarie Honegger and Andreas Pluckthun developed a structure based numbering scheme (AHo), which introduces gaps in the CDR regions to minimize deviation from the average structure of the aligned domains. (Honegger, A., and Plückthun, A. (2001). J. Mol. Biol. 309, 657-670) This leads to structurally equivalent positions having the same residue number when two different antibodies are compared. This enables comparison of the effect of substitutions in the variable domain framework region between antibodies. FIGS. 5-7 provide the AHo numbering for human heavy chain, kappa, and lambda variable domain regions, respectively.

As used herein, the term "framework" or "framework sequence" refers to the region or sequence of a variable region minus the CDRs. Because the exact definition of a CDR sequence can be determined by different systems, the meaning of a framework sequence is subject to correspondingly different interpretations. The six CDRs (CDR-L1, -L2, and -L3 of light chain and CDR-H1, -H2, and -H3 of heavy chain) also divide the framework regions on the light chain and the heavy chain into four sub-regions (FR1, FR2, FR3 and FR4) on each chain, in which CDR1 is positioned between FR1 and FR2, CDR2 between FR2 and FR3, and CDR3 between FR3 and FR4. Without specifying the particular sub-regions as FR1, FR2, FR3 or FR4, a framework region, represents the combined FR's within the variable region of a single, naturally occurring immunoglobulin chain. As used herein, a FR represents one of the four sub-regions, and FRs represents two or more of the four sub-regions constituting a framework region.

"Substituting" or "substitution of" an amino acid refers to substituting the original amino acid residue for one or more other amino acid residue(s).

Heavy Chain Modifications

To maximize efficiency of a particular heavy chain binding to its cognate light chain, both the heavy and light chains contain complimentary amino acid substitutions. By "complimentary amino acid substitutions," it is meant that a substitution to a positive-charge amino acid in the heavy chain is paired with a negative-charged amino acid substitution to an amino acid in the light chain that associates with the heavy chain residue. Likewise, a substitution to a negative-charge amino acid in the heavy chain is paired with a positive-charged amino acid substitution to an amino acid in the light chain that associates with the heavy chain residue.

In some embodiments, an antibody heavy chain variable region is engineered. FIG. 5 is a germline alignment of human heavy chain variable domain V and J regions. In some embodiments, the heterodimeric antibody comprises a heavy chain variable region that is at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, or at least about 99% identical to a human germline heavy chain variable region.

V region interface residues (i.e., amino acid residues that mediate assembly of the VH and VL domains) within the VH domain include AHo positions 1 (Kabat position 1), 3 (Kabat position 3), 42 (Kabat position 35), 44 (Kabat position 37), 46 (Kabat position 39), 50 (Kabat position 43), 51 (Kabat position 44), 52 (Kabat position 45), 53 (Kabat position 46), 54 (Kabat position 47), 57 (Kabat position 50), 70 (Kabat position 59), 103 (Kabat position 89), 105 (Kabat position 91), and 107 (Kabat position 93). J region interface residues within the include AHo positions 139 (Kabat position 103), 140 (Kabat position 104), 141 (Kabat position 105), and 142 (Kabat position 106). In some embodiments, one or more interface residues are substituted with a charged (positive- or negative-charged) amino acid.

In some embodiments, the amino acid at AHo position 46 (Kabat position 39) of the VH domain is replaced with a positive-charged amino acid. In alternative embodiments, the amino acid at AHo position 46 (Kabat position 39) of the VH domain is replaced with a negative-charged amino acid.

In some embodiments, the amino acid at AHo position 51 (Kabat position 44) and/or AHo position 141 (Kabat position 105) of the VH domain are replaced with a charged amino acid. In some embodiments, the amino acid at AHo position 51 is substituted for a positive-charged amino acid, e.g., lysine. In alternative embodiments, the amino acid at AHo position 51 is substituted for a negative-charged amino acid, e.g., aspartic acid. In some embodiments, the amino acid at AHo position 141 is substituted for a positive-charged amino acid, e.g., lysine. In alternative embodiments, the amino acid at AHo position 141 is substituted for a negative-charged amino acid, e.g., aspartic acid. In some embodiments, the amino acid at AHo positions 51 and AHo position 141 are substituted for a positive-charged amino acid, e.g., lysine, or a negative charged amino acid, e.g., aspartic acid. Such embodiments may further comprise a substitution at AHo position 46 to a positive- or negative-charged amino acid.

The CH1 region of the heavy chain also complexes with the light chain, and this region can be engineered to increase the efficiency of a particular heavy chain pairing with its cognate light chain. Assembly may be facilitated by introducing a cysteine residue into the heavy and light chain at or near the interface to allow formation of di-sulfide bonds, altering amino acids to create a knobs-into-holes effect, and electros engineering similar to that described herein for the variable regions.

In some embodiments, the heterodimeric antibody comprises a heavy chain CH1 region that is at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, or at least about 99% identical to a human germline heavy chain CH1 region.

In some embodiments, one or more amino acids in the CH1 domain of the heterodimeric antibody at an EU position selected from the group consisting of F126, P127, L128, A141, L145, K147, D148, H168, F170, P171, V173, Q175, S176, S183, V185 and K213 is/are replaced with a charged amino acid. In this regard, a particularly preferred residue for substitution with a negative- or positive-charged amino acid is S183 (EU numbering system). In some embodiments, S183 is substituted with a positive-charged amino acid. In alternative embodiments, S183 is substituted with a negative-charged amino acid.

The heterodimeric antibody described herein optionally further comprises two CH3 domains, at least one of which contains one or more substitutions introducing a non-native charged amino acid into the domain. In some embodiments, each CH3 domain comprises one or more amino acid substitutions in the CH3 domain to disfavor homodimerization, and more preferably, favor heterodimerization with the corresponding CH3 domain. International Publication No. WO 2009/089004 (incorporated herein by reference in its entirety) describes compositions and methods for engineering the CH3 domain interface to decrease homodimerization and increase heterodimerization between two CH3-domain-containing molecules. In some embodiments, amino acids at one or more positions selected from the group consisting of 399, 356 and 357 (EU numbering system) of the CH3 domain are replaced with a negative-charged amino acid. In some embodiments, amino acids at one or more positions selected from the group consisting of 370, 392 and 409 (EU numbering system) are replaced with a positive-charged amino acid. In alternative embodiments, amino acids at one or more positions selected from the group consisting of 399, 356 and 357 (EU numbering system) of the CH3 domain are replaced with a positive-charged amino acid. In further embodiments, amino acids at one or more positions selected from the group 370, 392 and 409 (EU numbering system) are replaced with a negative-charged amino acid. In some embodiments, the heterodimeric antibody comprises a first heavy chain comprising positive-charged amino acid at positions 399 and 356 (e.g., D399K and E356K), and a second heavy chain comprising negative-charged amino acids at positions 392 and 409 (e.g., K392D and K409D).

In one aspect, a heterodimeric antibody described herein comprises (a) a first amino acid substitution at an AHo position selected from the group consisting of AHo positions 42-50 that introduces a charged amino acid at said position, (b) a second amino acid substitution at an EU position selected from the group consisting of EU positions 126-213 that introduces a charged amino acid at said position, (c) a third amino acid substitution at an EU position selected from the group consisting of EU positions 352-360 that introduces a charged amino acid at said position, and (d) a fourth amino acid substitution at an EU position selected from the group consisting of EU positions 395-403 that introduces a charged amino acid, wherein the charged amino acid of (a) has the same charge as the charged amino acid of (b), and wherein the charged amino acids of (c) and (d) have an opposite charge of the charged amino acids of (a) and (b). For example, in some embodiments, the charged amino acids of (a) and (b) have a positive-charge and the charged amino acids of (c) and (d) have a negative-charge. In alternative embodiments, the charged amino acids of (a) and (b) have a negative-charge and the charged amino acids of (c) and (d) have a positive-charge. In some embodiments, the first amino acid substitution is at position AHo 46, the second amino acid substitution is at EU position 183, the third amino acid substitution is at EU position 356 and the fourth amino acid substitution is at EU position 399.

In another aspect, a heterodimeric antibody described herein comprises a heavy chain comprising (a) a first amino acid substitution at an AHo position selected from the group consisting of AHo positions 42-50 that introduces a charged amino acid at said position, (b) a second amino acid substitution at an EU position selected from the group consisting of EU positions 126-213 that introduces a charged amino acid at said position, (c) a third amino acid substitution at an EU position selected from the group consisting of EU positions 388-397 that introduces a charged amino acid at said position, and (d) a fourth amino acid substitution at an EU position selected from the group consisting of EU positions 404-413 that introduces a charged amino acid, wherein the charged amino acid of (a) has the same charge as the charged amino acid of (b), and wherein the charged amino acids of (c) and (d) have an opposite charge of the charged amino acids of (a) and (b). For example, in some embodiments, the charged amino acids of (a) and (b) have a positive-charge and the charged amino acids of (c) and (d) have a negative-charge. In alternative embodiments, the charged amino acids of (a) and (b) have a negative-charge and the charged amino acids of (c) and (d) have a positive-charge. In some embodiments, the first amino acid substitution is at AHo position 46, the second amino acid substitution is at EU position 183, the third amino acid substitution is at EU position 392 and the fourth amino acid substitution is at EU position 409.

Also provided herein is a heterodimeric antibody comprising a first heavy chain and a second heavy chain and a first light chain and a second light chain, wherein the first heavy chain comprises amino acid substitutions at positions 46 (AHo, Kabat 39), 183 (EU), 356 (EU) and 399 (EU), wherein the second heavy chain comprises amino acid substitutions at positions 46 (AHo), 183 (EU), 392 (EU) and 409 (EU), and wherein the first and second light chains comprise an amino acid substitution at positions 46 (AHo, Kabat 38) and 176 (EU), wherein the amino acid substitutions introduce a charged amino acid at said positions. In some embodiments, the glutamine at position AHo 46 (Kabat 39) of the first heavy chain is replaced with glutamic acid, the glutamine at position AHo 46 (Kabat 39) of the second heavy chain is replaced with lysine, the glutamine at position AHo 46 (Kabat 38) of the first light chain is replaced with lysine, the glutamine at position AHo 46 (Kabat 38) of the second light chain is replaced with glutamic acid, the serine at position 183 (EU) of the first heavy chain is replaced with glutamic acid, the glutamic acid at position 356 (EU) of the first heavy chain is replaced with lysine, the glutamic acid at position 399 (EU) of the first heavy chain is replaced with lysine, the serine at position 183 (EU) of the second heavy chain is replaced with lysine, the lysine at position 392 (EU) of the second heavy chain is replaced with aspartic acid, and/or the lysine at position 409 (EU) of the second heavy chain is replaced with aspartic acid.

In another aspect, described herein is an antibody that binds to a region of sclerostin comprising amino acids 86-111 of SEQ ID NO: 1, wherein the antibody comprises a heavy chain having a CH3 domain comprising one or more amino acid substitutions, wherein the one or more substitutions introduce charged amino acids that are electrostatically unfavorable to homodimer formation and electrostatically favorable to heterodimer formation. In some embodiments, a negative charged amino acid in the CH3 domain (e.g., at EU position D399, E356 or E357) is substituted with a positive charged amino acid. In some embodiments, amino acids at EU positions D399, E356 and E357 are substituted with a positive charged amino acid (e.g., lysine). International Publication No. WO 2009/089004 (incorporated herein by reference in its entirety) describes compositions and methods for engineering the CH3 domain interface to decrease homodimerization and increase heterodimerization between two CH3-domain-containing molecules.

Light Chain Modifications

As discussed above, to maximize binding of a particular heavy chain to its cognate light chain, both the heavy and light chains preferably contain complimentary amino acid substitutions to electrostatically steer the chains to assemble. Thus, in various embodiments, a light chain comprises one or more amino acid substitutions that compliment a heavy chain substitution discussed above.

In some embodiments, the light chain is a kappa light chain. FIG. 6 is a germline alignment of human kappa light chain variable domain V and J regions. In some embodiments, the heterodimeric antibody comprises a kappa chain variable region that is at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, or at least about 99% identical to a human germline kappa chain variable region.

V region interface residues (i.e., amino acid residues that mediate assembly of the VH and VL domains) within the VL domain include AHo positions 40 (Kabat 32), 42 (Kabat 34), 43 (Kabat 35), 44 (Kabat 36), 46 (Kabat 38), 49 (Kabat 41), 50 (Kabat 42), 51 (Kabat 43), 52 (Kabat 44), 53 (Kabat 45), 54 (Kabat 46), 56 (Kabat 48), 57 (Kabat 49), 58 (Kabat 50), 67 (Kabat 51), 69 (Kabat 53), 70 (Kabat 54), 71 (Kabat 55), 72 (Kabat 56), 73 (Kabat 57), 74 (Kabat 58), 103 (Kabat 85), 105 (Kabat 87), 107 (Kabat 89), 108 (Kabat 90), and 109 (Kabat 91). J region residues include AHo positions 116, 117, and 118. In some embodiments, one or more interface residues in the VL domain are substituted with a charged amino acid, preferably that has an opposite charge to those introduces into the cognate heavy chain variable domain (i.e., the VH domain). In some embodiments, the amino acid at AHo position 46 (Kabat 38) of the VL domain is replaced with a positive-charged amino acid. In some embodiments, such as when the amino acid at AHo position 46 (Kabat 39) in the VH domain is substituted with a positive-charged amino acid), the amino acid at AHo position 46 (Kabat 38) of the VL domain is replaced with a negative-charged amino acid.

In some embodiments, the amino acid at AHo positions 51 (Kabat 43) and/or AHo position 141 (Kabat 100) are substituted for a positive- or negative-charged amino acid. Such embodiments may further include having the amino acid at AHo position 46 substituted for a positive- or negative-charged amino acid. In some embodiments, the amino acid at AHo position 51 is substituted for a positive-charged amino acid, e.g., lysine. In alternative embodiments, the amino acid at AHo position 51 is substituted for a negative-charged amino acid, e.g., aspartic acid. In some embodiments, the amino acid at AHo position 141 is substituted for a positive-charged amino acid, e.g., lysine. In alternative embodiments, the amino acid at AHo position 141 is substituted for a negative-charged amino acid, e.g., aspartic acid. In some embodiments, the amino acid at AHo position 51 and AHo position 141 are substituted for a positive-charged amino acid, e.g., lysine, or a negative-charged amino acid, e.g., aspartic acid. Such embodiments may further comprise a substitution at AHo position 46 (Kabat 38) to a positive- or negative-charged amino acid.

The constant region of the light chain (i.e., the CL domain) also complexes with the heavy chain, and this region can be engineered to increase the efficiency of a particular light chain pairing with its cognate heavy chain. Assembly may be facilitated by introducing a cysteine residue into the heavy and light chain at or near the interface to allow formation of di-sulfide bonds, altering amino acids to create a knobs-into-holes effect, and electrostatic engineering similar to that described herein for the variable regions.

In embodiments where the light chain, is a kappa light chain, one or more amino acids in the CL domain of the heterodimeric antibody at a position (EU and Kabat numbering in a kappa light chain) selected from the group consisting of F116, F118, S121, D122, E123, Q124, S131, V133, L135, N137, N138, Q160, S162, T164, S174 and S176 are replaced with a charged amino acid. In some embodiments, an exemplary residue for substitution with a negative- or positive-charged amino acid is the amino acid at position 176 (EU and Kabat numbering system) of the CL domain. In some embodiments, the amino acid at position 176 of the CL domain is replaced with a positive-charged amino acid. In alternative embodiments, the amino acid at position 176 of the CL domain is replaced with a negative-charged amino acid, e.g., aspartic acid.

In some embodiments, the light chain is a lambda light chain. In some embodiments, one or more amino acids in the CL domain of the heterodimeric antibody at a position (Kabat numbering in a lambda chain) selected from the group consisting of T116, F118, S121, E123, E124, K129, T131, V133, L135, S137, E160, T162, S165, Q167, A174, S176 and Y178 are replaced with a charged amino acid. In some embodiments, an exemplary residue for substitution with a negative- or positive-charged amino acid is the amino acid at position 176 (EU and Kabat numbering system) of the CL domain. In some embodiments, the amino acid at position 176 of the CL domain is replaced with a positive-charged amino acid. In alternative embodiments, the amino acid at position 176 of the CL domain is replaced with a negative-charged amino acid, e.g., aspartic acid.

FIG. 7 is a germline alignment of human lambda light chain variable domain V and J regions. In some embodiments, the antigen binding protein or antibody comprises a light chain variable region that is at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, or at least about 99% identical to a human germline lambda chain variable region.

V region interface residues of the human germline lambda chain variable region in the CL domain include AHo positions 40 (Kabat 32), 42 (Kabat 34), 43 (Kabat 35), 44 (Kabat 36), 46 (Kabat 38), 49 (Kabat 41), 50 (Kabat 42), 51 (Kabat 43), 52 (Kabat 44), 53 (Kabat 45), 54 (Kabat 46), 56 (Kabat 48), 57 (Kabat 49), 58 (Kabat 50), 67 (Kabat 51), 69 (Kabat 53), 70 (Kabat 54), 71 (Kabat 55), 72 (Kabat 56), 73 (Kabat 57), 74 (Kabat 58), 103 (Kabat 85), 105 (Kabat 87), 107 (Kabat 89), 108 (Kabat 90), and 109 (Kabat 91). J region residues include AHo positions 139 and 140. The substitution of one or more of the amino acids at these positions with a charged amino acid is contemplated. In preferred embodiments, the one or more amino acids is substituted with a positive- or negative-charged amino acid, which is an opposite charge to those introduce into the cognate heavy chain variable domain.

In some embodiments, the amino acid at AHo positions 51 (Kabat 43) and/or AHo position 141 (Kabat 100) of the lambda variable region are substituted for a positive- or negative-charged amino acid. Such embodiments may further include having the amino acid at AHo position 46 substituted for a positive- or negative-charged amino acid. In some embodiments, the amino acid at AHo position 51 is substituted for a positive-charged amino acid, e.g., lysine. In alternative embodiments, the amino acid at AHo position 51 is substituted for a negative-charged amino acid, e.g., aspartic acid. In some embodiments, the amino acid at AHo position 141 is substituted for a positive-charged amino acid, e.g., lysine. In alternative embodiments, the amino acid at AHo position 141 is substituted for a negative-charged amino acid, e.g., aspartic acid. In some embodiments, the amino acid at AHo position 51 and AHo position 141 are substituted for a positive-charged amino acid, e.g., lysine, or a negative-charged amino acid, e.g., aspartic acid. Such embodiments may further comprise a substitution at AHo position 46 to a positive- or negative-charged amino acid.

Optional Further Modifications

The heavy chains of the heterodimeric antibodies described herein may further comprise one of more mutations that affect binding of the antibody containing the heavy chains to one or more Fc receptors. One of the functions of the Fc portion of an antibody is to communicate to the immune system when the antibody binds its target. This is commonly referenced as "effector function." Communication leads to antibody-dependent cellular cytotoxicity (ADCC), antibody-dependent cellular phagocytosis (ADCP), and/or complement dependent cytotoxicity (CDC). ADCC and ADCP are mediated through the binding of the Fc to Fc receptors on the surface of cells of the immune system. CDC is mediated through the binding of the Fc with proteins of the complement system, e.g., C1q.

In addition, the heterodimeric antibodies described herein may have amino acid modifications in the constant region to modify effector function of the antibody, including half-life or clearance, ADCC and/or CDC activity. Such modifications can enhance pharmacokinetics or enhance the therapeutic effectiveness of the antibody, for example. See Shields et al., J. Biol. Chem., 276(9):6591-6604 (2001), incorporated by reference herein in its entirety.

The IgG subclasses vary in their ability to mediate effector functions. For example, IgG1 is superior to IgG2 and IgG4 at mediating ADCC and CDC. The effector function of an antibody can be increased, or decreased, by introducing one or more mutations into the Fc. Embodiments of the invention include heterodimeric antibodies, having an Fc engineered to increase effector function (U.S. Pat. No. 7,317,091 and Strohl, Curr. Opin. Biotech., 20:685-691, 2009; both incorporated herein by reference in its entirety). Exemplary IgG1 Fc molecules having increased effector function include those having one or more of the following substitutions [numbering based on the EU numbering scheme]:
S239D/I332E
S239D/A330S/I332E
S239D/A330L/I332E
S298A/D333A/K334A
P247I/A339D
P247I/A339Q
D280H/K290S
D280H/K290S/S298D
D280H/K290S/S298V
F243L/R292P/Y300L
F243L/R292P/Y300L/P396L
F243L/R292P/Y300L/V305I/P396L
G236A/S239D/I332E
K326A/E333A
K326W/E333S
K290E/S298G/T299A
K290N/S298G/T299A
K290E/S298G/T299A/K326E
K290N/S298G/T299A/K326E
K334V
L235S+S239D+K334V
Q311M+K334V
S239D+K334V
F243V+K334V
E294L+K334V
S298T+K334V
E233L+Q311M+K334V
L234I+Q311M+K334V
S298T+K334V
A330M+K334V
A330F+K334V
Q311M+A330M+K334V
Q311M+A330F+K334V
S298T+A330M+K334V
S298T+A330F+K334V
S239D+A330M+K334V
S239D+S298T+K334V
L234Y+K290Y+Y296W
L234Y+F243V+Y296W
L234Y+E294L+Y296W
L234Y+Y296W
K290Y+Y296W Further embodiments of the invention include heterodimeric antibodies, having an Fc engineered to decrease effector function. Exemplary Fc molecules having decreased effector function include those having one or more of the following substitutions [numbering based on the EU numbering scheme]:
N297A (IgG1)
L234A/L235A (IgG1)
V234A/G237A (IgG2)
L235A/G237A/E318A (IgG4)
H268Q/V309L/A330S/A331S (IgG2)
C220S/C226S/C229S/P238S (IgG1)
C226S/C229S/E233P/L234V/L235A (IgG1)
L234F/L235E/P331S (IgG1)
S267E/L328F (IgG1)

Another method of increasing effector function of IgG Fc-containing proteins is by reducing the fucosylation of the Fc. Removal of the core fucose from the biantennary complex-type oligosachharides attached to the Fc greatly increased ADCC effector function without altering antigen binding or CDC effector function. Several methods are known for reducing or abolishing fucosylation of Fc-containing molecules, e.g., antibodies. These include recombinant expression in certain mammalian cell lines including a FUT8 knockout cell line, variant CHO line Lec13, rat hybridoma cell line YB2/0, a cell line comprising a small interfering RNA specifically against the FUT8 gene, and a cell line coexpressing β-1,4-N-acetylglucosaminyltransferase III and Golgi β-mannosidase II. Alternatively, the Fc-containing molecule may be expressed in a non-mammalian cell such as a plant cell, yeast, or prokaryotic cell, e.g., *E. coli*. Thus, in certain embodiments, a composition comprises an antibody having reduced fucosylation or lacking fucosylation altogether.

It is contemplated that essentially any antibody variable domain may be incorporated into the heterodimeric antibody format described herein. Exemplary antibody variable domains (and the antigen to which they specifically bind) include, but are not limited to, those described in U.S. Pat. No. 7,947,809 and U.S. Patent Application Publication No. 20090041784 (glucagon receptor), U.S. Pat. Nos. 7,939,070, 7,833,527, 7,767,206, and 7,786,284 (IL-17 receptor A), U.S. Pat. Nos. 7,872,106 and 7,592,429 (Sclerostin), U.S. Pat. Nos. 7,871,611, 7,815,907, 7,037,498, 7,700,742, and U.S. Patent Application Publication No. 20100255538 (IGF-1 receptor), U.S. Pat. No. 7,868,140 (B7RP1), U.S. Pat. No. 7,807,159 and U.S. Patent Application Publication No. 20110091455 (myostatin), U.S. Pat. No. 7,736,644, U.S. Pat. No. 7,628,986, U.S. Pat. No. 7,524,496, and U.S. Patent Application Publication No. 20100111979 (deletion mutants of epidermal growth factor receptor), U.S. Pat. No. 7,728,110 (SARS coronavirus), U.S. Pat. No. 7,718,776 and U.S. Patent Application Publication No. 20100209435 (OPGL), U.S. Pat. Nos. 7,658,924 and 7,521,053 (Angiopoietin-2), U.S. Pat. Nos. 7,601,818, 7,795,413, U.S. Patent Application Publication No. 20090155274, U.S. Patent Application Publication No. 20110040076 (NGF), U.S. Pat. No. 7,579,186 (TGF-β type II receptor), U.S. Pat. No. 7,541,438 (connective tissue growth factor), U.S. Pat. No. 7,438,910 (IL1-R1), U.S. Pat. No. 7,423,128 (properdin), U.S. Pat. Nos. 7,411,057, 7,824,679, 7,109,003, 6,682,736, 7,132,281, and 7,807,797 (CTLA-4), U.S. Pat. Nos. 7,084,257, 7,790,859, 7,335,743, 7,084,257, and U.S. Patent Application Publicaiton No. 20110045537 (interferon-gamma), U.S. Pat. No. 7,932,372 (MAdCAM), U.S. Pat. No. 7,906,625, U.S. Patent Application Publication No. 20080292639, and U.S. Patent Application Publicaiton No. 20110044986 (amyloid), U.S. Pat. Nos. 7,815,907 and 7,700,742 (insulin-like growth factor I), U.S. Pat. Nos. 7,566,772 and 7,964,193 (interleukin-1β), U.S. Pat. Nos. 7,563,442, 7,288,251, 7,338, 660, 7,626,012, 7,618,633, and U.S. Patent Application Publication No. 20100098694 (CD40), U.S. Pat. No. 7,498,420 (c-Met), U.S. Pat. Nos. 7,326,414, 7,592,430, and 7,728,113 (M-CSF), U.S. Pat. Nos. 6,924,360, 7,067,131, 7,090,844 (MUC18), U.S. Pat. Nos. 6,235,883, 7,807,798, and U.S. Patent Application Publication No. 20100305307 (epidermal growth factor receptor), U.S. Pat. Nos. 6,716,587, 7,872,113, 7,465,450, 7,186,809, 7,317,090, and 7,638,606 (interleukin-4 receptor), U.S. Patent Application Publication No. 20110135657 (BETA-KLOTHO), U.S. Pat. Nos. 7,887,799 and 7,879,323 (fibroblast growth factor-like polypeptides), U.S. Pat. No. 7,867,494 (IgE), U.S. Patent Application Publication No. 20100254975 (ALPHA-4 BETA-7), U.S. Patent Application Publication No. 20100197005 and U.S. Pat. No. 7,537,762 (ACTIVIN RECEPTOR-LIKE KINASE-1), U.S. Pat. No. 7,585,500 and U.S. Patent Application Publication No. 20100047253 (IL-13), U.S. Patent Application Publication No. 20090263383 and U.S. Pat. No. 7,449,555 (CD148), U.S. Patent Application Publication No. 20090234106 (ACTIVIN A), U.S. Patent Application Publication No. 20090226447 (angiopoietin-1 and angiopoietin-2), U.S. Patent Application Publication No. 20090191212 (Angiopoietin-2), U.S. Patent Application Publicaiton No. 20090155164 (C-FMS), U.S. Pat. No. 7,537,762 (activin receptor-like kinase-1), U.S. Pat. No. 7,371,381 (galanin), U.S. Patent Application Publication No. 20070196376 (INSULIN-LIKE GROWTH FACTORS), U.S. Pat. No. 7,267,960 and U.S. Pat. No. 7,741,115 (LDCAM), U.S. Pat. No. 7,265,212 (CD45RB), U.S. Pat. No. 7,709,611, U.S. Patent Application Publication No. 20060127393 and U.S. Patent Application Publication No. 20100040619 (DKK1), U.S. Pat. No. 7,807,795, U.S. Patent Application Publication No. 20030103978 and U.S. Pat. No. 7,923,008 (osteoprotegerin), U.S. Patent Application Publication No. 20090208489 (OV064), U.S. Patent Application Publication No. 20080286284 (PSMA), U.S. Pat. No. 7,888,482, U.S. Patent Application Publication No. 20110165171, and U.S. Patent Application Publication No. 20110059063 (PAR2), U.S. Patent Application Publication No. 20110150888 (HEPCIDIN), U.S. Pat. No. 7,939,640 (B7L-1), U.S. Pat. No. 7,915,391 (c-Kit), U.S. Pat. Nos. 7,807,796, 7,193,058, and 7,427,669 (ULBP), U.S. Pat. Nos. 7,786,271, 7,304,144, and U.S. Patent Application Publication No. 20090238823 (TSLP), U.S. Pat. No. 7,767,793 (SIGIRR), U.S. Pat. No. 7,705,130 (HER-3), U.S. Pat. No. 7,704,501 (ataxin-1-like polypeptide), U.S. Pat. Nos. 7,695,948 and 7,199,224 (TNF-α converting enzyme), U.S. Patent Application Publication No. 20090234106 (ACTIVIN A), U.S. Patent Application Publication No. 20090214559 and U.S. Pat. No. 7,438,910 (IL1-R1), U.S. Pat. No. 7,579,186 (TGF-β type II receptor), U.S. Pat. No. 7,569,387 (TNF receptor-like molecules), U.S. Pat. No. 7,541,438, (connective tissue growth factor), U.S. Pat. No. 7,521,048 (TRAIL receptor-2), U.S. Pat. Nos. 6,319,499, 7,081,523, and U.S. Patent Application Publication No. 20080182976 (erythropoietin receptor), U.S. Patent Application Publication No. 20080166352 and U.S. Pat. No. 7,435,796 (B7RP1), U.S. Pat. No. 7,423,128 (properdin), U.S. Pat. Nos. 7,422,742 and 7,141,653 (interleukin-5), U.S. Pat. Nos. 6,740,522 and 7,411,050 (RANKL), U.S. Pat. No. 7,378,091 (carbonic anhydrase IX (CA IX) tumor antigen), U.S. Pat. Nos. 7,318,925 and 7,288,253 (parathyroid hormone), U.S. Pat. No. 7,285,269 (TNF), U.S. Pat. No. 6,692,740 and U.S. Pat. No. 7,270,817 (ACPL), U.S. Pat. No. 7,202,343 (monocyte chemo-attractant protein-1), U.S. Pat. No. 7,144,731 (SCF), U.S. Pat. Nos. 6,355,779 and 7,138,500 (4-1BB), U.S. Pat. No. 7,135,174 (PDGFD), U.S. Pat. Nos. 6,630,143 and 7,045,128 (Flt-3 ligand), U.S. Pat. No. 6,849,450 (metalloproteinase inhibitor), U.S. Pat. No. 6,596,852 (LERK-5), U.S. Pat. No. 6,232,447 (LERK-6), U.S. Pat. No. 6,500,429 (brain-derived neurotrophic factor), U.S. Pat. No. 6,184,359 (epithelium-derived T-cell factor), U.S. Pat. No. 6,143,874 (neurotrophic factor NNT-1), U.S. Patent Application Publication No. 20110027287 (PROPROTEIN CONVERTASE SUBTILISIN KEXIN TYPE 9 (PCSK9)), U.S. Patent Application Publication No. 20110014201 (IL-18 RECEPTOR), and U.S. Patent Application Publication No. 20090155164 (C-FMS). The above patents and published patent applications are incorporated herein by reference in their entirety for purposes of their disclosure of variable domain polypeptides, variable domain encoding nucleic acids, host cells, vectors, methods of making polypeptides encoding said variable domains, pharmaceutical compositions, and methods of treating diseases associated with the respective target of the variable domain-containing antigen binding protein or antibody.

Antibodies and Fragments Thereof

The heterodimeric antibodies described herein, in some embodiments, comprise anti-sclerostin and anti-DKK1 antibodies and fragments thereof as described herein (e.g., a heterodimeric antibody comprising a heavy and light chain that mediates binding to sclerostin and a heavy and light chain that mediates binding to DKK1). The term "antibody" refers to an intact antibody, or a binding fragment thereof. An antibody may comprise a complete antibody (immunoglobulin) molecule (including polyclonal, monoclonal, chimeric, humanized, and/or human versions having full length heavy and/or light chains), or comprise an antigen binding fragment thereof. Antibody fragments include F(ab')$_2$, Fab, Fab', Fv, Fc, and Fd fragments, and can be incorporated into single domain antibodies (e.g., nanobodies), single-chain antibodies, maxibodies, minibodies, intrabodies, diabodies, triabodies, tetrabodies, v-NAR and bis-scFv (see, e.g., Hollinger and Hudson, *Nature Biotechnology,* 23(9):1126-1136 (2005)). Antibody polypeptides, including fibronectin polypeptide monobodies, also are disclosed in U.S. Pat. No. 6,703,199. Other antibody polypeptides are disclosed in U.S. Patent Publication No. 20050238646.

An antibody fragment may be a synthetic or genetically engineered protein. For example, antibody fragments include isolated fragments consisting of the light chain variable region, "Fv" fragments consisting of the variable regions of the heavy and light chains, and recombinant single chain polypeptide molecules in which light and heavy variable regions are connected by a peptide linker (scFv proteins).

Another form of an antibody fragment is a peptide comprising one or more complementarity determining regions (CDRs) of an antibody. As used herein, the term "CDR" refers to the complementarity determining region within antibody variable sequences. There are three CDRs in each of the variable regions of the heavy chain and the light chain, which are designated CDR1, CDR2 and CDR3, for each of the variable regions. The term "CDR set" as used herein refers to a group of three CDRs that occur in a single variable region capable of binding the antigen. The exact boundaries of these CDRs have been defined differently according to different systems. The system described by Kabat (Kabat et al., Sequences of Proteins of Immunological Interest (National Institutes of Health, Bethesda, Md. (1987) and (1991)) not only provides an unambiguous residue numbering system applicable to any variable region of an antibody, but also provides precise residue boundaries defining the three CDRs. These CDRs may be referred to as Kabat CDRs. Chothia and coworkers (Chothia & Lesk, J. Mol. Biol. 196:901-917 (1987) and Chothia et al., Nature 342:877-883 (1989)) found that certain sub-portions within Kabat CDRs adopt nearly identical peptide backbone conformations, despite having great diversity at the level of amino acid sequence. These sub-portions were designated as L1, L2 and L3 or H1, H2 and H3 where the "L" and the "H" designates the light chain and the heavy chains regions, respectively. These regions may be referred to as Chothia CDRs, which have boundaries that overlap with Kabat CDRs. Other boundaries defining CDRs overlapping with the Kabat CDRs have been described by Padlan (FASEB J. 9:133-139 (1995)) and MacCallum (J Mol Biol 262(5): 73245 (1996)). Still other CDR boundary definitions may not strictly follow one of the above systems, but will nonetheless overlap with the Kabat CDRs, although they may be shortened or lengthened in light of prediction or experimental findings that particular residues or groups of residues or even entire CDRs do not significantly impact antigen binding. The methods used herein may utilize CDRs defined according to any of these systems, although preferred embodiments use Kabat or Chothia defined CDRs.

CDRs (also termed "minimal recognition units" or "hypervariable region") are obtained by, e.g., constructing polynucleotides that encode the CDR of interest. Such polynucleotides are prepared, for example, by using the polymerase chain reaction to synthesize the variable region using mRNA of antibody-producing cells as a template (see, for example, Larrick et al., *Methods: A Companion to Methods in Enzymology*, 2:106 (1991); Courtenay-Luck, "Genetic Manipulation of Monoclonal Antibodies," in *Monoclonal Antibodies Production, Engineering and Clinical Application*, Ritter et al. (eds.), page 166, Cambridge University Press (1995); and Ward et al., "Genetic Manipulation and Expression of Antibodies," in *Monoclonal Antibodies: Principles and Applications*, Birch et al., (eds.), page 137, Wiley-Liss, Inc. (1995)).

The methods and antibody chains described herein are useful for generating heterodimeric antibodies. "Specifically binds" as used herein means that the antigen binding protein preferentially binds the antigen over other proteins. In some embodiments "specifically binds" means the antigen binding protein has a higher affinity for the antigen than for other proteins. Antigen binding proteins that specifically bind an antigen may have a binding affinity for the antigen of less than or equal to $1\times10^{-7}$ M, less than or equal to $2\times10^{-7}$ M, less than or equal to $3\times10^{-7}$ M, less than or equal to $4\times10^{-7}$ M, less than or equal to $5\times10^{-7}$ M, less than or equal to $6\times10^{-7}$ M, less than or equal to $7\times10^{-7}$ M, less than or equal to $8\times10^{-7}$ M, less than or equal to $9\times10^{-7}$ M, less than or equal to $1\times10^{-8}$ M, less than or equal to $2\times10^{-8}$ M, less than or equal to $3\times10^{-8}$ M, less than or equal to $4\times10^{-8}$ M, less than or equal to $5\times10^{-8}$ M, less than or equal to $6\times10^{-8}$ M, less than or equal to $7\times10^{-8}$ M, less than or equal to $8\times10^{-8}$ M, less than or equal to $9\times10^{-8}$ M, less than or equal to $1\times10^{-9}$ M, less than or equal to $2\times10^{-9}$ M, less than or equal to $3\times10^{-9}$ M, less than or equal to $4\times10^{-9}$ M, less than or equal to $5\times10^{-9}$ M, less than or equal to $6\times10^{-9}$ M, less than or equal to $7\times10^{-9}$ M, less than or equal to $8\times10^{-9}$ M, less than or equal to $9\times10^{-9}$ M, less than or equal to $1\times10^{-10}$ M, less than or equal to $2\times10^{-10}$ M, less than or equal to $3\times10^{-10}$ M, less than or equal to $4\times10^{-10}$ M, less than or equal to $5\times10^{-10}$ M, less than or equal to $6\times10^{-10}$ M, less than or equal to $7\times10^{-10}$ M, less than or equal to $8\times10^{-10}$ M, less than or equal to $9\times10^{-10}$ M, less than or equal to $1\times10^{-11}$ M, less than or equal to $2\times10^{-11}$ M, less than or equal to $3\times10^{-11}$ M, less than or equal to $4\times10^{-11}$ M, less than or equal to $5\times10^{-11}$ M, less than or equal to $6\times10^{-11}$ M, less than or equal to $7\times10^{-11}$ M, less than or equal to $8\times10^{-11}$ M, less than or equal to $9\times10^{-11}$ M, less than or equal to $1\times10^{-12}$ M, less than or equal to $2\times10^{-12}$ M, less than or equal to $3\times10^{-12}$ M, less than or equal to $4\times10^{-12}$ M, less than or equal to $5\times10^{-12}$ M, less than or equal to $6\times10^{-12}$ M, less than or equal to $7\times10^{-12}$ M, less than or equal to $8\times10^{-12}$ M, or less than or equal to $9\times10^{-12}$ M.

Anti-Sclerostin Antibodies

In some embodiments, the heterodimeric antibody described herein comprises a sclerostin binding portion comprising an anti-sclerostin antibody. An "anti-sclerostin antibody" binds to sclerostin or portions thereof to block or impair binding of human sclerostin to one or more ligands. Sclerostin, the product of the SOST gene, is absent in sclerosteosis, a skeletal disease characterized by bone overgrowth and strong dense bones (Brunkow et al., Am. J. Hum. Genet., 68:577-589 (2001); Balemans et al., Hum. Mol. Genet., 10:537-543 (2001)). The amino acid sequence of human sclerostin is reported by Brunkow et al. and is disclosed in U.S. Patent Publication No. 20070110747 as SEQ ID NO: 1 (which patent publication is incorporated as in its entirety for its description of sclerostin binding agents and Sequence Listing). Recombinant human sclerostin/SOST is commercially available from R&D Systems (Minneapolis, Minn., USA; 2006 Catalog #1406-ST-025). Additionally, recombinant mouse sclerostin/SOST is commercially available from R&D Systems (Minneapolis, Minn., USA; 2006 Catalog #1589-ST-025). Research grade sclerostin-binding monoclonal antibodies are commercially available from R&D Systems (Minneapolis, Minn., USA; mouse monoclonal: 2006 Catalog # MAB1406; rat monoclonal: 2006 Catalog # MAB1589). U.S. Pat. Nos. 6,395,511 and 6,803,453, and U.S. Patent Publication Nos. 2004/0009535 and 2005/0106683 refer to anti-sclerostin antibodies generally. Examples of sclerostin binding agents suitable for use in the context of the invention also are described in U.S. Patent Publication Nos. 2007/0110747 and 2007/0072797, which are hereby incorporated by reference. Additional information regarding materials and methods for generating sclerostin binding agents can be found in U.S. Patent Publication No. 20040158045 (hereby incorporated by reference).

Anti-sclerostin antibodies or fragments thereof may bind to sclerostin of SEQ ID NO: 1, or a naturally occurring variant thereof, with an affinity (Kd) of less than or equal to $1\times10^{-7}$ M, less than or equal to $1\times10^{-8}$ M, less than or equal to $1\times10^{-9}$ M, less than or equal to $1\times10^{-10}$ M, less than or equal to $1\times10^{-11}$ M, or less than or equal to $1\times10^{-12}$ M. Affinity is determined using a variety of techniques, an example of which is an affinity ELISA assay. In various embodiments, affinity is determined by a BIAcore assay. In various embodiments, affinity is determined by a kinetic method. In various embodiments, affinity is determined by an equilibrium/solution method. U.S. Patent Publication No. 2007/0110747 contains additional description of affinity assays suitable for determining the affinity (Kd) of an antibody for sclerostin.

In some or any embodiments, the anti-sclerostin antibody or antibody fragment binds to a sclerostin polypeptide comprising the amino acid sequence set forth in SEQ ID NO: 1 and binds a region of sclerostin comprising the sequence of SEQ ID NO: 6 (CGPARLLPNAIGRGKW-WRPSGPDFRC; corresponding to amino acids 86-111 of SEQ ID NO: 1). This region is also referred to herein as the "loop 2" region of sclerostin. Regions of sclerostin outside of the loop 2 region are defined herein as "non-loop 2 regions." Alternatively or in addition, the anti-sclerostin antibody binds to a sclerostin polypeptide comprising amino acids 57-146 of SEQ ID NO: 1. Alternatively or in addition, the anti-sclerostin antibody binds to a sclerostin polypeptide comprising amino acids 89-103 of SEQ ID NO: 1 and/or amino acids 137-151 of SEQ ID NO: 1. Alternatively or in addition, the anti-sclerostin antibody binds to a sclerostin polypeptide comprising the amino acid sequence set forth in SEQ ID NO: 1 and binds the sequence of at least one of SEQ ID NO: 2 (DVSEYSCRELHFTR; corresponding to amino acids 51-64 of SEQ ID NO: 1), SEQ ID NO: 3 (SAKPVTELVCSGQCGPAR; corresponding to amino acids 73-90 of SEQ ID NO: 1), SEQ ID NO: 4 (WWRPSGPDFRCIPDRYR; corresponding to amino acids 101-117 of SEQ ID NO: 1), SEQ ID NO: 5 (LVASCKCKRLTR; corresponding to amino acids 138-149 of SEQ ID NO: 1), SEQ ID NO: 70 (SAKPVTELVCSGQC; corresponding to amino acids 73-86 of SEQ ID NO: 1), SEQ ID NO: 71 (LVASCKC; corresponding to amino acids 138-144 of SEQ ID NO: 1), SEQ ID NO: 72 (C1RELHFTR; corresponding to amino acids 57-64 of SEQ ID NO: 1), or SEQ ID NO: 73 (CIPDRYR; corresponding to amino acids 111-117 of SEQ ID NO: 1) within SEQ ID NO: 1. For example, in one aspect, the anti-sclerostin antibody binds a subregion of sclerostin of SEQ ID NO: 1 comprising SEQ ID NOs: 2-5 (and/or SEQ ID NOs: 70-73), optionally in its native three-dimensional conformation. Optionally, the anti-sclerostin antibody binds a peptide consisting of one or more of SEQ ID NO: 2, SEQ ID NO: 3, SEQ ID NO: 4, SEQ ID NO: 5, SEQ ID NO: 6, SEQ ID NO: 70, SEQ ID NO: 71, SEQ ID NO: 72, or SEQ ID NO: 73 (e.g., a peptide consisting of SEQ ID NO: 2, SEQ ID NO: 3, SEQ ID NO: 4, and SEQ ID NO: 5 or a peptide consisting of SEQ ID NO: 70, SEQ ID NO: 71, SEQ ID NO: 72, and SEQ ID NO: 73).

In some or any embodiments, the anti-sclerostin antibody binds to a sclerostin polypeptide comprising amino acids 89-103 and 137-151 of SEQ ID NO: 1.

In some or any embodiments, the anti-sclerostin antibody binds to a sclerostin polypeptide having the amino acid sequences of SEQ ID NO:2, SEQ ID NO:3, SEQ ID NO:4 and SEQ ID NO:5, wherein SEQ ID NO:2 and 4 are joined by a disulfide bond at amino acid positions 57 and 111 with reference to SEQ ID NO:1, and SEQ ID NO:3 and 5 are joined by at least one of (a) a disulfide bond at amino acid positions 82 and 142 with reference to SEQ ID NO:1, and (b) a disulfide bond at amino acid positions 86 and 144 with reference to SEQ ID NO:1; the polypeptide may retain the tertiary structure of the corresponding polypeptide region of human sclerostin of SEQ ID NO:1. Alternatively or in addition, the anti-sclerostin antibody binds a polypeptide having the amino acid sequences of SEQ ID NO: 70, SEQ ID NO: 71, SEQ ID NO: 72 and SEQ ID NO: 73, wherein SEQ ID NO: 72 and 73 are joined by a disulfide bond at amino acid positions 57 and 111 with reference to SEQ ID NO: 1, and SEQ ID NO: 70 and 71 are joined by at least one of (a) a disulfide bond at amino acid positions 82 and 142 with reference to SEQ ID NO: 1, and (b) a disulfide bond at amino acid positions 86 and 144 with reference to SEQ ID NO: 1.

Optionally, the anti-sclerostin antibody binds a peptide consisting essentially of the amino acid sequences of SEQ ID NO: 2, SEQ ID NO: 3, SEQ ID NO: 4 and SEQ ID NO: 5, wherein SEQ ID NO: 2 and 4 are joined by a disulfide bond at amino acid positions 57 and 111 with reference to SEQ ID NO: 1, and SEQ ID NO: 3 and 5 are joined by at least one of (a) a disulfide bond at amino acid positions 82 and 142 with reference to SEQ ID NO: 1, and (b) a disulfide bond at amino acid positions 86 and 144 with reference to SEQ ID NO: 1.

Optionally, the anti-sclerostin antibody binds to a polypeptide consisting essentially of a multiply truncated human sclerostin protein of SEQ ID NO: 1, wherein (a) amino acids 1-50, 65-72, 91-100, 118-137, and 150-190 of SEQ ID NO: 1 are absent from said polypeptide or (b) amino acids 1-56, 65-72, 87-110, 118-137, and 145-190 of SEQ ID NO: 1 are absent from said polypeptide.

In some or any embodiments, the anti-sclerostin antibody binds to a polypeptide having the amino acid sequences of SEQ ID NO: 70, SEQ ID NO: 71, SEQ ID NO: 72 and SEQ ID NO: 73, wherein SEQ ID NO: 72 and 73 are joined by a disulfide bond at amino acid positions 57 and 111 with reference to SEQ ID NO: 1, and SEQ ID NO: 70 and 71 are joined by at least one of (a) a disulfide bond at amino acid positions 82 and 142 with reference to SEQ ID NO: 1, and (b) a disulfide bond at amino acid positions 86 and 144 with reference to SEQ ID NO: 1.

In some or any embodiments, the sclerostin polypeptide retains the tertiary structure of the corresponding polypeptide region of human sclerostin of SEQ ID NO: 1.

In some or any embodiments, the anti-sclerostin antibody binds to (i) a portion of human sclerostin comprising amino acids 51-64, 73-90, 101-117, and 138-149 of SEQ ID NO: 1, wherein said portion has at least one, at least two or all three of: (a) a disulfide bond between amino acids 57 and 111; (b) a disulfide bond between amino acids 82 and 142; and (c) a disulfide bond between amino acids 86 and 144; or (ii) a portion of human sclerostin comprising amino acids 57-64, 73-86, 111-117, and 138-144 of SEQ ID NO: 1, wherein said portion has at least one, at least two, or all three of: (a) a disulfide bond between amino acids 57 and 111; (b) a disulfide bond between amino acids 82 and 142; and (c) a disulfide bond between amino acids 86 and 144.

In some or any embodiments, the anti-sclerostin antibody also binds to an epitope of SEQ ID NO: 6.

Anti-sclerostin antibodies for use in generating the heterodimeric antibodies described herein preferably modulate sclerostin function in the cell-based assay described in U.S. Patent Publication No. 2007/0110747 and/or the in vivo assay described in U.S. Patent Publication No. 20070110747 and/or bind to one or more of the epitopes described in U.S. Patent Publication No. 2007/0110747 and/or cross-block the binding of one of the antibodies described in U.S. Patent Publication No. 2007/0110747 and/or are cross-blocked from binding sclerostin by one of the antibodies described in U.S. Patent Publication No. 2007/0110747 (incorporated by reference in its entirety and for its description of assays for characterizing an anti-sclerostin antibody).

In various aspects, the anti-sclerostin antibody is also capable of neutralizing human sclerostin in a MC3T3 cell-based mineralization assay when there is less than a 6-fold excess of moles of sclerostin binding sites per well as compared to the number of moles of sclerostin per well. Mineralization by osteoblast-lineage cells in culture, either primary cells or cell lines, is used as an in vitro model of bone formation. An exemplary cell-based mineralization assay is described in U.S. Patent Publication No. 20070110747 at, e.g., Example 8 (hereby incorporated by reference). MC3T3-E1 cells (Sudo et al., J. Cell Biol., 96:191-198 (1983)) and subclones of the original cell line can form mineral in culture upon growth in the presence of differentiating agents. Such subclones include MC3T3-E1-BF (Smith et al., J. Biol. Chem., 275:19992-20001 (2000)). For both the MC3T3-E1-BF subclone as well as the original MC3T3-E1 cells, sclerostin can inhibit one or more of the sequence of events leading up to and including mineral deposition (i.e., sclerostin inhibits mineralization). Anti-sclerostin antibodies that are able to neutralize sclerostin's inhibitory activity allow for mineralization of the culture in the presence of sclerostin such that there is a statistically significant increase in, e.g., deposition of calcium phosphate (measured as calcium) as compared to the amount of calcium measured in the sclerostin-only (i.e., no antibody) treatment group.

When running the assay with the goal of determining whether a particular anti-sclerostin antibody (or other sclerostin inhibitor) can neutralize sclerostin, the amount of sclerostin used in the assay desirably is the minimum amount of sclerostin that causes at least a 70%, statistically significant, reduction in deposition of calcium phosphate (measured as calcium) in the sclerostin-only group, as compared to the amount of calcium measured in the no sclerostin group. An anti-sclerostin neutralizing antibody is defined as one that causes a statistically significant increase in deposition of calcium phosphate (measured as calcium) as compared to the amount of calcium measured in the sclerostin-only (i.e., no antibody) treatment group. To determine whether an anti-sclerostin antibody is neutralizing or not, the amount of anti-sclerostin antibody used in the assay needs to be such that there is an excess of moles of sclerostin binding sites per well as compared to the number of moles of sclerostin per well. Depending on the potency of the antibody, the fold excess that may be required can be 24, 18, 12, 6, 3, or 1.5, and one of skill is familiar with the routine practice of testing more than one concentration of binding agent (antibody). For example, a very potent anti-sclerostin neutralizing antibody will neutralize sclerostin when there is less than a 6-fold excess of moles of sclerostin binding sites per well as compared to the number of moles of sclerostin per well. A less potent anti-sclerostin neutralizing antibody will neutralize sclerostin only at a 12, 18 or 24 fold excess.

The anti-sclerostin antibody optionally has an IC50 of 100 nM or less, or 75 nM or less, or 50 nM or less, or 25 nM or less for neutralizing human sclerostin in a cell-based assay, such as a bone specific alkaline phosphatase assay, e.g., the bone specific alkaline phosphatase assay described in International Patent Publication No. WO 2008/115732 and U.S. Pat. No. 7,744,874 (incorporated herein by reference in its entirety for its description of cell-based assays and anti-sclerostin antibodies). The bone specific alkaline phosphatase assay is predicated on the ability of sclerostin to decrease BMP-4 and Wnt3a-stimulated alkaline phosphatase levels in the multipotential murine cell line, C2C12. According to WO 2008/115732, a neutralizing anti-sclerostin antibody mediates a dose-dependent increase of alkaline phosphatase activity in this assay.

Alternatively or in addition, the anti-sclerostin antibody has an IC50 of 100 nM or less (e.g., 75 nM or less, or 50 nM or less) for neutralizing human sclerostin in a cell-based Wnt signaling assay in HEK293 cell lines, such as the Wnt assay involving Wnt1-mediated induction of STF reporter gene described in e.g., International Patent Publication No. WO 2009/047356 (incorporated by reference for its discussion of anti-sclerostin antibodies and cell-based assays). Alternatively or in addition, the anti-sclerostin antibody has an IC50 of 500 nM or less (e.g., 250 nM or less, 150 nM or less, 100 nM or less, or 50 nM or less) for neutralizing human sclerostin in a BMP2-induced mineralization assay in MC3T3 cells, such as the mineralization assay described in e.g., International Patent Publication No. WO 2009/047356.

Examples of anti-sclerostin antibodies suitable for use in the context of the invention are described in U.S. Patent Publication Nos. 2007/0110747 and 2007/0072797, which are hereby incorporated by reference. In some embodiments, the anti-sclerostin antibody cross-blocks the binding of at least one of antibodies Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, and Ab-24 (all of which are described in U.S. Patent Publication No. 20070110747) to sclerostin. Alternatively or in addition, the anti-sclerostin antibody is cross-blocked from binding to sclerostin by at least one of antibodies Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, and Ab-24 (all of which are described in U.S. Patent Publication No. 20070110747). The terms "cross-block," "cross-blocked," and "cross-blocking" are used interchangeably herein to mean the ability of an antibody to interfere with the binding of other antibodies to sclerostin. The extent to which an antibody is able to interfere with the binding of another to sclerostin, and therefore whether it can be said to cross-block, can be determined using competition binding assays. In some aspects of the invention, a cross-blocking antibody or fragment thereof reduces sclerostin binding of a reference antibody between about 40% and about 100%, such as about 60% and about 100%, specifically between 70% and 100%, and more specifically between 80% and 100%. A particularly suitable quantitative assay for detecting cross-blocking uses a Biacore machine which measures the extent of interactions using surface plasmon resonance technology. Another suitable quantitative cross-blocking assay uses an ELISA-based approach to measure competition between antibodies in terms of their binding to sclerostin.

In some embodiments, the anti-sclerostin antibody cross-blocks the binding of an immunoglobulin comprising full length heavy and light chains to sclerostin of SEQ ID NO: 1 and/or is cross-blocked from binding to sclerostin of SEQ ID NO: 1 by an immunoglobulin comprising full length heavy and light chains, wherein the immunoglobulin comprising full length heavy and light chains comprise CDR sequences disclosed herein, such as one of the following three sets of CDR sequences: a) CDR-L1 of SEQ ID NO: 284, CDR-L2 of SEQ ID NO: 285, CDR-L3 of SEQ ID NO: 286, CDR-H1 of SEQ ID NO: 296, CDR-H2 of SEQ ID NO: 297, and CDR-H3 of SEQ ID NO: 298; b) CDR-L1 of SEQ ID NO: 48, CDR-L2 of SEQ ID NO: 49, CDR-L3 of SEQ ID NO: 50, CDR-H1 of SEQ ID NO: 45, CDR-H2 of SEQ ID NO: 46, and CDR-H3 of SEQ ID NO: 47; or c) CDR-L1 of SEQ ID NO: 42, CDR-L2 of SEQ ID NO: 43, CDR-L3 of SEQ ID NO: 44, CDR-H1 of SEQ ID NO: 39, CDR-H2 of SEQ ID NO: 40, and CDR-H3 of SEQ ID NO: 41. Alternatively, or in addition, the anti-sclerostin antibody cross-blocks the binding of immunoglobulin comprising full length heavy and light chains to sclerostin of SEQ ID NO: 1 and/or is cross-blocked from binding to sclerostin of SEQ ID NO: 1 by an immunoglobulin comprising full length heavy and light chains, wherein the immunoglobulin comprising full length heavy and light chains comprise the following CDRs: CDR-H1 of SEQ ID NO: 245, CDR-H2 of SEQ ID NO: 246, CDR-H3 of SEQ ID NO: 247, CDR-L1 of SEQ ID NO: 78, CDR-L2 of SEQ ID NO: 79 and CDR-L3 of SEQ ID NO: 80.

Alternatively, or in addition, the anti-sclerostin antibody cross-blocks the binding of immunoglobulin comprising full length heavy and light chains to sclerostin of SEQ ID NO:

1 and/or is cross-blocked from binding to sclerostin of SEQ ID NO: 1 by an immunoglobulin comprising full length heavy and light chains, wherein the immunoglobulin comprising full length heavy and light chains comprise the following CDRs: CDR-H1 of SEQ ID NO: 269, CDR-H2 of SEQ ID NO: 270, CDR-H3 of SEQ ID NO: 271, CDR-L1 of SEQ ID NO: 239, CDR-L2 of SEQ ID NO: 240 and CDR-L3 of SEQ ID NO: 241.

Examples of suitable anti-sclerostin antibodies and fragments thereof include antibodies and antibody fragments having one or more of CDR-H1, CDR-H2, CDR-H3, CDR-L1, CDR-L2 and CDR-L3 specifically disclosed herein and disclosed in U.S. Patent Publication No. 2007/0110747. At least one of the regions of CDR-H1, CDR-H2, CDR-H3, CDR-L1, CDR-L2, and CDR-L3 may have at least one amino acid substitution, provided that the antibody retains the binding specificity of the non-substituted CDR. Exemplary the anti-sclerostin antibodies include, but are not limited to, Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, and Ab-24 of U.S. Patent Publication No. 2007/0110747. Other exemplary anti-sclerostin antibodies include, but are not limited to, 27H6, 19D11 and 20C3.

In addition, the anti-sclerostin antibody can comprise at least one CDR sequence having at least 75% identity (e.g., 100% identity) to a CDR selected from SEQ ID NOs: 39, 40, 41, 42, 43, 44, 45, 46, 47, 48, 49, 50, 51, 52, 53, 54, 55, 56, 57, 58, 59, 60, 61, 62, 78, 79, 80, 81, 99, 100, 101, 102, 103, 104, 105, 106, 107, 108, 109, 110, 111, 112, 113, 114, 115, 116, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 351, 352, 353, 358, 359, and 360 provided in the Sequence Listing and disclosed in U.S. Patent Publication No. 20070110747. In addition, the anti-sclerostin antibody can comprise at least one CDR sequence having at least 75% identity (e.g., 100% identity) to a CDR selected from SEQ ID NOs: 417-422, 425-430 and 433-438 provided in the Sequence Listing. Preferably, the anti-sclerostin antibody comprises at least one CDR sequence having at least 75% identity to a CDR selected from SEQ ID NOs: 245, 246, 247, 78, 79, 80, 269, 270, 271, 239, 240, and 241, all of which is provided in the Sequence Listing and described in U.S. Patent Publication No. 20070110747. As described in U.S. Patent Publication No. 2007/0110747, the anti-sclerostin antibody can comprise: a) CDR sequences of SEQ ID NOs:54, 55, and 56 and CDR sequences of SEQ ID NOs:51, 52, and 53; b) CDR sequences of SEQ ID NOs:60, 61, and 62 and CDR sequences of SEQ ID NOs:57, 58, and 59; c) CDR sequences of SEQ ID NOs:48, 49, and 50 and CDR sequences of SEQ ID NOs:45, 46, and 47; d) CDR sequences of SEQ ID NOs:42, 43, and 44 and CDR sequences of SEQ ID NOs:39, 40, and 41; e) CDR sequences of SEQ ID NOs:275, 276, and 277 and CDR sequences of SEQ ID NOs:287, 288, and 289; f) CDR sequences of SEQ ID NOs:278, 279, and 280 and CDR sequences of SEQ ID NOs:290, 291, and 292; g) CDR sequences of SEQ ID NOs:78, 79, and 80 and CDR sequences of SEQ ID NOs: 245, 246, and 247; h) CDR sequences of SEQ ID NOs:81, 99, and 100 and CDR sequences of SEQ ID NOs:248, 249, and 250; i) CDR sequences of SEQ ID NOs:101, 102, and 103 and CDR sequences of SEQ ID NOs:251, 252, and 253; j) CDR sequences of SEQ ID NOs:104, 105, and 106 and CDR sequences of SEQ ID NOs:254, 255, and 256; k) CDR sequences of SEQ ID NOs:107, 108, and 109 and CDR sequences of SEQ ID NOs:257, 258, and 259; l) CDR sequences of SEQ ID NOs:110, 111, and 112 and CDR sequences of SEQ ID NOs:260, 261, and 262; m) CDR sequences of SEQ ID NOs:281, 282, and 283 and CDR sequences of SEQ ID NOs:293, 294, and 295; n) CDR sequences of SEQ ID NOs:113, 114, and 115 and CDR sequences of SEQ ID NOs:263, 264, and 265; o) CDR sequences of SEQ ID NOs:284, 285, and 286 and CDR sequences of SEQ ID NOs:296, 297, and 298; p) CDR sequences of SEQ ID NOs:116, 237, and 238 and CDR sequences of SEQ ID NOs:266, 267, and 268; q) CDR sequences of SEQ ID NOs:239, 240, and 241 and CDR sequences of SEQ ID NOs:269, 270, and 271) CDR sequences of SEQ ID NOs:242, 243, and 244 and CDR sequences of SEQ ID NOs:272, 273, and 274; or s) CDR sequences of SEQ ID NOs:351, 352, and 353 and CDR sequences of SEQ ID NOs:358, 359, and 360.

The anti-sclerostin antibody can comprise at least one CDR sequence having at least 75% identity (e.g., 100% identical) to a CDR selected from CDR-H1, CDR-H2, CDR-H3, CDR-L1, CDR-L2, and CDR-L3 wherein CDR-H1 has the sequence given in SEQ ID NO: 245, CDR-H2 has the sequence given in SEQ ID NO: 246, CDR-H3 has the sequence given in SEQ ID NO: 247, CDR-L1 has the sequence given in SEQ ID NO: 78, CDR-L2 has the sequence given in SEQ ID NO: 79 and CDR-L3 has the sequence given in SEQ ID NO: 80, all of which is provided in the Sequence Listing and described in U.S. Patent Publication No. 20070110747. The anti-sclerostin antibody, in various aspects, comprises two of the CDRs or six of the CDRs. Optionally, the anti-sclerostin antibody comprises all or part of a heavy chain (e.g., two heavy chains) comprising SEQ ID NO: 378 and all or part of a light chain (e.g., two light chains) comprising SEQ ID NO 376.

The anti-sclerostin antibody can comprise at least one CDR sequence having at least 75% identity (e.g., 100% identical) to a CDR selected from CDR-H1, CDR-H2, CDR-H3, CDR-L1, CDR-L2, and CDR-L3 wherein CDR-H1 has the sequence given in SEQ ID NO: 269, CDR-H2 has the sequence given in SEQ ID NO: 270, CDR-H3 has the sequence given in SEQ ID NO: 271, CDR-L1 has the sequence given in SEQ ID NO: 239, CDR-L2 has the sequence given in SEQ ID NO: 240 and CDR-L3 has the sequence given in SEQ ID NO 241, all of which is provided in the Sequence Listing and described in U.S. Patent Publication No. 20070110747. The anti-sclerostin antibody, in various aspects, comprises at least two of the CDRs or six of the CDRs. Optionally, the anti-sclerostin antibody comprises all or part of a heavy chain (e.g., two heavy chains) comprising SEQ ID NO: 366 and all or part of a light chain (e.g., two light chains) comprising SEQ ID NO 364.

Alternatively, the anti-sclerostin antibody can have a heavy chain comprising CDR's H1, H2, and H3 and comprising a polypeptide having the sequence provided in SEQ ID NO: 137, 145, or 392 or a variant thereof in which the CDRs are at least 75% identical (e.g., 100% identical) to SEQ ID NO: 245, 246, and 247, respectively, and a light chain comprising CDR's L1, L2 and L3 and comprising a polypeptide having the sequence provided in SEQ ID NO: 133 or 141 or a variant thereof in which the CDRs are at least 75% identical (e.g., 100% identical) to SEQ ID NO: 78, 79, and 80, respectively (as described in U.S. Patent Publication No. 2007/0110747).

The anti-sclerostin antibody may have a heavy chain comprising CDR's H1, H2, and H3 and comprising a polypeptide having the sequence provided in SEQ ID NO: 335, 331, 345, or 396 or a variant of any of the foregoing in which the CDRs are at least 75% (e.g., 100% identical) identical to SEQ ID NO: 269, 270, and 271, respectively, and a light chain comprising CDR's L1, L2, and L3 and comprising a polypeptide having the sequence provided in SEQ ID NO: 334 or 341 or a variant of any of the foregoing in which the CDRs are at least 75% identical (e.g., 100% identical) to SEQ ID NO: 239, 240, and 241, respectively (as described in U.S. Patent Publication No. 20070110747). All combinations of the heavy and light chain sequences are contemplated (e.g., heavy chains comprising SEQ ID NO: 335 and light chains comprising SEQ ID NO: 334; heavy chains comprising SEQ ID NO: 331 and light chains comprising SEQ ID NO: 334 or 341; and heavy chains comprising SEQ ID NO: 345 or 396 and light chains comprising SEQ ID NO: 341).

Alternatively, the anti-sclerostin antibody has a heavy chain comprising a polypeptide having the sequence provided in SEQ ID NO:137, and a light chain comprising a polypeptide having the sequence provided in SEQ ID NO:133; a heavy chain comprising a polypeptide having the sequence provided in SEQ ID NO:145 or 392, and a light chain comprising a polypeptide having the sequence provided in SEQ ID NO: 141; a heavy chain comprising a polypeptide having the sequence provided in SEQ ID NO:335, and a light chain comprising a polypeptide having the sequence provided in SEQ ID NO:334; a heavy chain comprising a polypeptide having the sequence provided in SEQ ID NO:331, and a light chain comprising a polypeptide having the sequence provided in SEQ ID NO:341; or a heavy chain comprising a polypeptide having the sequence provided in SEQ ID NO:345 or 396, and a light chain comprising a polypeptide having the sequence provided in SEQ ID NO:341 (as described in U.S. Patent Publication No. 2007/0110747). Alternatively, the anti-sclerostin antibody cross-blocks (or is cross-blocked by) any of the aforementioned antibodies to sclerostin.

In some embodiments, the anti-sclerostin antibody comprises a heavy chain that comprises an amino acid sequence selected from the group consisting of SEQ ID NO: 1038, SEQ ID NO: 1046, SEQ ID NO: 1040 and SEQ ID NO: 1048; optionally further comprising a light chain amino acid sequence selected from the group consisting of SEQ ID NO: 1039, SEQ ID NO: 1047, SEQ ID NO: 1041 and SEQ ID NO: 1049.

Examples of anti-sclerostin antibodies also include, but are not limited to, the anti-sclerostin antibodies disclosed in International Patent Publication Nos. WO 2008/092894, WO 2008/115732, WO 2009/056634, WO 2009/047356, WO 2010/100200, WO 2010/100179, WO 2010/115932, and WO 2010/130830 (each of which is incorporated by reference herein in its entirety), such as an anti-sclerostin antibody comprising CDRs of SEQ ID NOs: 20-25 of International Patent Publication No. WO 2008/115732 (SEQ ID NOs: 416-421 herein), an anti-sclerostin antibody comprising CDRs of SEQ ID NOs: 26-31 of International Patent Publication No. WO 2008/115732 (SEQ ID NOs: 422-427 herein), an anti-sclerostin antibody comprising CDRs of SEQ ID NOs: 32-37 of International Patent Publication No. WO 2008/115732 (SEQ ID NOs: 428-433 herein), an anti-sclerostin antibody comprising CDRs of SEQ ID NOs: 4, 15, 26, 37, 48, and 59 of International Patent Publication No. WO 2009/047356 (SEQ ID NOs: 443, 454, 465, 476, 487 and 498, respectively, herein), or an anti-sclerostin antibody comprising the amino acid sequence of at least one of SEQ ID NOs: 135-143, 153-161, or 171-179 of International Patent Publication No. WO 2010/130830 (SEQ ID NOs: 745-753, 763-771, 781-789, respectively, herein).

Anti-DKK1 Antibodies

In some embodiments, the heterodimeric antibody described herein comprises a DKK1 binding portion comprising an anti-DKK1 antibody. An "anti-DKK1 antibody" binds to DKK1 or portions thereof to block or impair binding of human DKK1 to one or more ligands. Human DKK1 polynucleotide and amino acid sequences are set forth in SEQ ID NOs: 810 and 811, respectively. Polynucleotide and amino acid sequences for mouse and rat DKK1 are set forth in SEQ ID NOs: 812 and 813 (mouse) and SEQ ID NOs: 814 and 815 (rat). Examples of anti-DKK1 antibodies suitable for use in the context of the invention are described in International Publication No. WO 2012/118903, the disclosure of which is incorporated herein by reference. In some embodiments, the anti-DKK1 antibody cross-blocks or competes with the binding of at least one of Antibodies 11H10Hu, 11H10Rat, 2.4.1, 2.20.1, 2.37.1, 2.40.1, 2.41.1, 2.47.1, 5.17.1, 5.23.1, 5.25.1, 5.31.1, 5.32.1, 5.40.1, 5.65.1, 5.76.1, 5.77.1, 5.78.1, 5.80.1, 5.85.1, 6.37.5, 6.116.6, 6.139.5 and 6.147.4 (all of which are described in International Publication No. WO 2012/118903) to DKK1. Alternatively, or in addition, the anti-DKK1 antibody is cross-blocked from binding to DKK1 by at least one of antibodies 11H10Hu, 11H10Rat, 2.4.1, 2.20.1, 2.37.1, 2.40.1, 2.41.1, 2.47.1, 5.17.1, 5.23.1, 5.25.1, 5.31.1, 5.32.1, 5.40.1, 5.65.1, 5.76.1, 5.77.1, 5.78.1, 5.80.1, 5.85.1, 6.37.5, 6.116.6, 6.139.5 and 6.147.4. The terms "cross-block," "cross-blocked," and "cross-blocking" are used interchangeably herein to mean the ability of an antibody to interfere with the binding of other antibodies to DKK1. The extent to which an antibody is able to interfere with the binding of another to DKK1, and therefore whether it can be said to cross-block, can be determined using competition binding assays. In some aspects, a cross-blocking antibody or fragment thereof reduces DKK1 binding of a reference antibody between about 40% and about 100%, such as about 60% and about 100%, or between 70% and 100%, or between 80% and 100%. A particularly suitable quantitative assay for detecting cross-blocking uses a Biacore machine which measures the extent of interactions using surface plasmon resonance technology. Another suitable quantitative cross-blocking assay uses an ELISA-based approach to measure competition between antibodies in terms of their binding to DKK1.

In some embodiments, the anti-DKK1 antibody cross-blocks the binding of an immunoglobulin comprising full length heavy and light chains to DKK1 of SEQ ID NO: 811 and/or is cross-blocked from binding to DKK1 of SEQ ID NO: 811 by an immunoglobulin comprising full length heavy and light chains, wherein the immunoglobulin comprising full length heavy and light chains comprises CDR sequences disclosed herein, such as one of the following three sets of CDR sequences: SEQ ID NOs: 820-822, 828-830, 836-838, 844-846, 852-854, 860-862, 868-869, 876-878, 884-886, 892-894, 900-902, 908-910, 916-918, 924-926, 932-934, 940-942, 948-950, 956-958, 964-966, 972-974, 980-982, 988-990, 996-998, 1004-1006, 823-825, 831-833, 839-841, 847-849, 855-857, 863-865, 871-873, 879-881, 887-889, 897-897, 903-905, 911-913, 919-921, 927-929, 935-937, 943-945, 951-953, 959-961, 967-969, 975-977, 983-985, 991-993, 999-1001 and 1007-1009.

Examples of suitable anti-DKK1 antibodies and fragments thereof include antibodies and antibody fragments having one or more of CDR-H1, CDR-H2, CDR-H3, CDR-L1, CDR-L2 and CDR-L3 specifically disclosed herein and disclosed in International Publication No. WO 2012/118903, which is incorporated herein by reference in its entirety. In some embodiments, at least one of the regions of CDR-H1, CDR-H2, CDR-H3, CDR-L1, CDR-L2, and CDR-L3 may have at least one amino acid substitution, provided that the antibody retains the binding specificity of the non-substituted CDR. Exemplary anti-DKK1 antibodies include, but are not limited to, Antibodies 11H10Hu, 11H10Rat, 2.4.1, 2.20.1, 2.37.1, 2.40.1, 2.41.1, 2.47.1, 5.17.1, 5.23.1, 5.25.1, 5.31.1, 5.32.1, 5.40.1, 5.65.1, 5.76.1, 5.77.1, 5.78.1, 5.80.1, 5.85.1, 6.37.5, 6.116.6, 6.139.5 and 6.147.4 (all of which are described in International Publication No. WO 2012/118903).

In some embodiments, the anti-DKK1 antibody comprises at least one CDR having at least 75% identity (e.g., at least 80%, or at least 85%, or at least 90%, or at least 95%, or at least 100% identity) to a CDR selected from the group consisting of 820-822 (CDRL1-L3 of Ab 11H10Hu), 828-830 (CDRL1-CDRL3 of Ab 11H10Rat), 836-838 (CDRL1-CDRL3 of Ab 2.4.1), 844-846 (CDRL1-CDRL3 of Ab 2.20.1), 852-854 (CDRL1-CDRL3 of Ab 2.37.1), 860-862 (CDRL1-CDRL3 of Ab 2.40.1), 868-869 (CDRL1-CDRL3 of Ab 2.41.1), 876-878 (CDRL1-CDRL3 of Ab2.47.1), 884-886 (CDRL1-CDRL3 of Ab 5.17.1), 892-894 (CDRL1-CDRL3 of Ab 5.23.1), 900-902 (CDRL1-CDRL3 of Ab 5.25.1), 908-910 (CDRL1-CDRL3 of Ab5.31.1), 916-918 (CDRL1-CDRL3 of Ab 5.32.1), 925-927 (CDRL1-CDRL3 of Ab 5.40.1), 932-934 (CDRL1-CDRL3 of Ab 5.65.1), 940-942 (CDRL1-CDRL3 of Ab5.77.1), 956-958 (CDRL1-CDRL3 of Ab 5.78.1), 964-966 (CDRL1-CDRL3 of Ab 5.80.1), 972-974 (CDRL1-CDRL3 of Ab 5.85.1), 980-982 (CDRL1-CDRL3 of Ab 6.37.5), 988-990 (CDRL1-CDRL3 of Ab 6.116.6), 996-998 (CDRL1-CDRL3 of Ab 6.139.5), 1004-1006 (CDRL1-CDRL3 of Ab 6.147.4), 823-825 (CDRH1-CDRH3 of Ab 11H10Hu), 831-833 (CDRH1-CDRH3 of Ab 11H10Rat), 839-841 (CDRH1-CDRH3 of Ab 2.4.1), 847-849 (CDRH1-CDRH3 of Ab 2.20.1), 855-857 (CDRH1-CDRH3 of Ab 2.37.1), 863-865 (CDRH1-CDRH3 of Ab 2.40.1), 871-873 (CDRH1-CDRH3 of Ab 2.41.1), 879-881 (CDRH1-CDRH3 of Ab 2.47.1), 887-889 (CDRH1-CDRH3 of Ab 5.17.1), 895-897 (CDRH1-CDRH3 of Ab 5.23.1), 903-905 (CDRH1-CDRH3 of Ab 5.25.1), 911-913 (CDRH1-CDRH3 of Ab 531.1), 919-921 (CDRH1-CDRH3 of Ab 5.32.1), 927-929 (CDRH1-CDRH3 of Ab 5.40.1), 935-937 (CDRH1-CDRH3 of Ab 5.65.1), 943-945 (CDRH1-CDRH3 of Ab 5.76.1), 951-953 (CDRH1-CDRH3 of Ab 5.77.1), 959-961 (CDRH1-CDRH3 of Ab 5.78.1), 967-969 (CDRH1-CDRH3 of Ab 5.80.1), 975-977 (CDRH1-CDRH3 of Ab5.85.1), 983-985 (CDRH1-CDRH3 of Ab 6.37.5), 991-993 (CDRH1-CDRH3 of Ab 6.116.6), 999-1001 (CDRH1-CDRH3 of Ab 6.139.5) and 1007-1009 (CDRH1-CDRH3 of Ab 6.147.4).

The anti-DKK1 antibody comprises, in some embodiments, having a heavy chain variable domain amino acid sequence having at least 75% identity (e.g., at least 80%, or at least 85%, or at least 90%, or at least 95%, or at least 100% identity) to an anti-DKK1 heavy chain variable domain amino acid sequence selected from the group consisting of SEQ ID NOs: 819, 827, 835, 843, 851, 859, 867, 875, 883, 891, 899, 907, 915, 923, 931, 939, 947, 955, 963, 971, 979, 987, 995 and 1003. In some embodiments, the anti-DKK1 antibody comprising a light chain variable domain amino acid sequence having at least 75% identity (e.g., at least 80%, or at least 85%, or at least 90%, or at least 95%, or at least 100% identity) to an anti-DKK1 light chain variable domain amino acid sequence selected from the group consisting of SEQ ID NOs: 818, 826, 834, 842, 850, 866, 874, 882, 890, 898, 906, 814, 822, 830, 938, 946, 954, 962, 970, 978, 988, 994 and 1002.

The DKK1 binding component(s) of the heterodimeric antibody comprises, in some embodiments, one, two, three, four, five or six of the CDRs set forth in SEQ ID NOs: of 820-822 (CDRL1-L3 of Ab 11H10Hu), 828-830 (CDRL1-CDRL3 of Ab 11H10Rat), 836-838 (CDRL1-CDRL3 of Ab 2.4.1), 844-846 (CDRL1-CDRL3 of Ab 2.20.1), 852-854 (CDRL1-CDRL3 of Ab 2.37.1), 860-862 (CDRL1-CDRL3 of Ab 2.40.1), 868-869 (CDRL1-CDRL3 of Ab 2.41.1), 876-878 (CDRL1-CDRL3 of Ab2.47.1), 884-886 (CDRL1-CDRL3 of Ab 5.17.1), 892-894 (CDRL1-CDRL3 of Ab 5.23.1), 900-902 (CDRL1-CDRL3 of Ab 5.25.1), 908-910 (CDRL1-CDRL3 of Ab5.31.1), 916-918 (CDRL1-CDRL3 of Ab 5.32.1), 925-927 (CDRL1-CDRL3 of Ab 5.40.1), 932-934 (CDRL1-CDRL3 of Ab 5.65.1), 940-942 (CDRL1-CDRL3 of Ab 5.76.1), 948-950 (CDRL1-CDRL3 of Ab5.77.1), 956-958 (CDRL1-CDRL3 of Ab 5.78.1), 964-966 (CDRL1-CDRL3 of Ab 5.80.1), 972-974 (CDRL1-CDRL3 of Ab 5.85.1), 980-982 (CDRL1-CDRL3 of Ab 6.37.5), 988-990 (CDRL1-CDRL3 of Ab 6.116.6), 996-998 (CDRL1-CDRL3 of Ab 6.139.5), 1004-1006 (CDRL1-CDRL3 of Ab 6.147.4), 823-825 (CDRH1-CDRH3 of Ab 11H10Hu), 831-833 (CDRH1-CDRH3 of Ab 11H10Rat), 839-841 (CDRH1-CDRH3 of Ab 2.4.1), 847-849 (CDRH1-CDRH3 of Ab 2.20.1), 855-857 (CDRH1-CDRH3 of Ab 2.37.1), 863-865 (CDRH1-CDRH3 of Ab 2.40.1), 871-873 (CDRH1-CDRH3 of Ab 2.41.1), 879-881 (CDRH1-CDRH3 of Ab 2.47.1), 887-889 (CDRH1-CDRH3 of Ab 5.17.1), 895-897 (CDRH1-CDRH3 of Ab 5.23.1), 903-905 (CDRH1-CDRH3 of Ab 5.25.1), 911-913 (CDRH1-CDRH3 of Ab 531.1), 919-921 (CDRH1-CDRH3 of Ab 5.32.1), 927-929 (CDRH1-CDRH3 of Ab 5.40.1), 935-937 (CDRH1-CDRH3 of Ab 5.65.1), 943-945 (CDRH1-CDRH3 of Ab 5.76.1), 951-953 (CDRH1-CDRH3 of Ab 5.77.1), 959-961 (CDRH1-CDRH3 of Ab 5.78.1), 967-969 (CDRH1-CDRH3 of Ab 5.80.1), 975-977 (CDRH1-CDRH3 of Ab5.85.1), 983-985 (CDRH1-CDRH3 of Ab 6.37.5), 991-993 (CDRH1-CDRH3 of Ab 6.116.6), 999-1001 (CDRH1-CDRH3 of Ab 6.139.5) and 1007-1009 (CDRH1-CDRH3 of Ab 6.147.4). It is contemplated that the heterodimeric antibody can include two or more CDRs from a single antibody, or two or more CDRs from any combination of the DKK1 antibodies described herein. Some DKK1 binding components include both the light chain CDR3 and the heavy chain CDR3. Certain DKK1 binding components have variant forms of the CDRs set forth in SEQ ID NOs: 820-822, 828-830, 836-838, 844-846, 852-854, 860-862, 868-869, 876-878, 884-886, 892-894, 900-902, 908-910, 916-918, 925-927, 932-934, 940-942, 948-950, 956-958, 964-966, 972-974, 980-982, 988-990, 996-998, 1004-1006, 823-825, 831-833, 839-841, 847-849, 855-857, 863-865, 871-873, 879-881, 887-889, 897-897, 903-905, 911-913, 919-921, 927-929, 935-937, 943-945, 951-953, 959-961, 967-969, 975-977, 983-985, 991-993, 999-1001 and 1007-1009, with one or more (i.e., 2, 3, 4, 5 or 6) of the CDRs each having at least 80%, 85%, 90% or 95% sequence identity to a CDR sequence set forth in SEQ ID NOs: 820-822, 828-830, 836-838, 844-846, 852-854, 860-862, 868-869, 876-878, 884-886, 892-894, 900-902, 908-910, 916-918, 925-927, 932-934, 940-942, 948-950, 956-958, 964-966, 972-974, 980-982, 988-990, 996-998, 1004-1006, 823-825, 831-833, 839-841, 847-849, 855-857, 863-865, 871-873, 879-881, 887-889, 897-897, 903-905, 911-913, 919-921, 927-929, 935-937, 943-945, 951-953, 959-961, 967-969, 975-977, 983-985, 991-993, 999-1001 and 1007-1009. For example, the DKK1 binding components of the heterodimeric antibody can include both a light chain CDR3 and a heavy chain CDR3 that each have at least 80%, 85%, 90% or 95% sequence identity to a light chain CDR3 sequence selected from the group consisting of SEQ ID NOs: 822, 830, 838, 846, 854, 862, 870, 878, 886, 894, 902, 910, 918, 926, 934, 942, 950, 958, 966, 974, 982, 990, 998 and 1006; and have at least 80%, 85%, 90% or 95% sequence identity to a heavy chain CDR3 sequence selected from the group consisting of 825, 833, 841, 849, 857, 865, 873, 881, 889, 897, 905, 913, 921, 929, 937, 945, 953, 961, 969, 977, 985, 993, 1001 and 1009.

The CDR sequences of some of the DKK1 binding components that are provided may also differ from the CDR sequences set forth in SEQ ID NOs: 820-822, 828-830, 836-838, 844-846, 852-854, 860-862, 868-869, 876-878, 884-886, 892-894, 900-902, 908-910, 916-918, 925-927, 932-934, 940-942, 948-950, 956-958, 964-966, 972-974, 980-982, 988-990, 996-998, 1004-1006, 823-825, 831-833, 839-841, 847-849, 855-857, 863-865, 871-873, 879-881, 887-889, 897-897, 903-905, 911-913, 919-921, 927-929, 935-937, 943-945, 951-953, 959-961, 967-969, 975-977, 983-985, 991-993, 999-1001 and 1007-1009 such that the amino acid sequence for any given CDR differs by no more than 1, 2, 3, 4 or 5 amino acid residues. Differences from the listed sequences are typically, but not limited to, conservative substitutions.

In some embodiments, the anti-DKK1 antibody comprises a heavy chain that comprises an amino acid sequence selected from the group consisting of SEQ ID NO: 1034, SEQ ID NO: 1042, SEQ ID NO: 1036 and SEQ ID NO: 1044; optionally further comprising a light chain amino acid sequence selected from the group consisting of SEQ ID NO: 1035, SEQ ID NO: 1043, SEQ ID NO: 1037 and SEQ ID NO: 1045.

In other embodiments, the portion of the heterodimeric molecule that binds to DKK1 is selected from those DKK1 binding molecules disclosed in U.S. Pat. No. 7,709,611, U.S. Patent Publ. No. 2008/0193449, U.S. Pat. No. 7,642,238, U.S. Pat. No. 7,700,101, and WO 2007/084344, the disclosure of all of which are incorporated herein by reference in their entireties.

Polynucleotides Encoding Engineered Heavy or Light Chains

Encompassed within the invention are nucleic acids encoding heavy and/or light chain constant and/or variable domains described herein. Nucleic acid molecules of the invention include DNA and RNA in both single-stranded and double-stranded form, as well as the corresponding complementary sequences. DNA includes, for example, cDNA, genomic DNA, chemically synthesized DNA, DNA amplified by PCR, and combinations thereof. The nucleic acid molecules of the invention include full-length genes or cDNA molecules as well as a combination of fragments thereof. The nucleic acids of the invention are preferentially derived from human sources, but the invention includes those derived from non-human species, as well.

An "isolated nucleic acid" is a nucleic acid that has been separated from adjacent genetic sequences present in the genome of the organism from which the nucleic acid was isolated, in the case of nucleic acids isolated from naturally-occurring sources. In the case of nucleic acids synthesized enzymatically from a template or chemically, such as PCR products, cDNA molecules, or oligonucleotides for example, it is understood that the nucleic acids resulting from such processes are isolated nucleic acids. An isolated nucleic acid molecule refers to a nucleic acid molecule in the form of a separate fragment or as a component of a larger nucleic acid construct. In one preferred embodiment, the nucleic acids are substantially free from contaminating endogenous material. The nucleic acid molecule has preferably been derived from DNA or RNA isolated at least once in substantially pure form and in a quantity or concentration enabling identification, manipulation, and recovery of its component nucleotide sequences by standard biochemical methods (such as those outlined in Sambrook et al., Molecular Cloning: A Laboratory Manual, 2nd ed., Cold Spring Harbor Laboratory, Cold Spring Harbor, N.Y. (1989)). Such sequences are preferably provided and/or constructed in the form of an open reading frame uninterrupted by internal non-translated sequences, or introns, that are typically present in eukaryotic genes. Sequences of non-translated DNA can be present 5' or 3' from an open reading frame, where the same do not interfere with manipulation or expression of the coding region.

The present invention also includes nucleic acids that hybridize under moderately stringent conditions, and more preferably highly stringent conditions, to nucleic acids encoding polypeptides as described herein. The basic parameters affecting the choice of hybridization conditions and guidance for devising suitable conditions are set forth by Sambrook, Fritsch, and Maniatis (1989, Molecular Cloning: A Laboratory Manual, Cold Spring Harbor Laboratory Press, Cold Spring Harbor, N.Y., chapters 9 and 11; and Current Protocols in Molecular Biology, 1995, Ausubel et al., eds., John Wiley & Sons, Inc., sections 2.10 and 6.3-6.4), and can be readily determined by those having ordinary skill in the art based on, for example, the length and/or base composition of the DNA. One way of achieving moderately stringent conditions involves the use of a prewashing solution containing 5×SSC, 0.5% SDS, 1.0 mM EDTA (pH 8.0), hybridization buffer of about 50% formamide, 6×SSC, and a hybridization temperature of about 55 degrees C. (or other similar hybridization solutions, such as one containing about 50% formamide, with a hybridization temperature of about 42 degrees C.), and washing conditions of about 60 degrees C., in 0.5×SSC, 0.1% SDS. Generally, highly stringent conditions are defined as hybridization conditions as above, but with washing at approximately 68 degrees C., 0.2×SSC, 0.1% SDS. SSPE (1×SSPE is 0.15M NaCl, 10 mM NaH$_2$PO$_4$, and 1.25 mM EDTA, pH 7.4) can be substituted for SSC (1×SSC is 0.15M NaCl and 15 mM sodium citrate) in the hybridization and wash buffers; washes are performed for 15 minutes after hybridization is complete. It should be understood that the wash temperature and wash salt concentration can be adjusted as necessary to achieve a desired degree of stringency by applying the basic principles that govern hybridization reactions and duplex stability, as known to those skilled in the art and described further below (see, e.g., Sambrook et al., 1989). When hybridizing a nucleic acid to a target nucleic acid of unknown sequence, the hybrid length is assumed to be that of the hybridizing nucleic acid. When nucleic acids of known sequence are hybridized, the hybrid length can be determined by aligning the sequences of the nucleic acids and identifying the region or regions of optimal sequence complementarity. The hybridization temperature for hybrids anticipated to be less than 50 base pairs in length should be 5 to 10.degrees C. less than the melting temperature (Tm) of the hybrid, where Tm is determined according to the following equations. For hybrids less than 18 base pairs in length, Tm (degrees C.)=2(# of A+T bases)+4(# of G+C bases). For hybrids above 18 base pairs in length, Tm (degrees C.)=81.5+16.6(log 10 [Na+])+0.41(% G+C)−(600/N), where N is the number of bases in the hybrid, and [Na+]

is the concentration of sodium ions in the hybridization buffer ([Na+] for 1×SSC=0.165M). Preferably, each such hybridizing nucleic acid has a length that is at least 15 nucleotides (or more preferably at least 18 nucleotides, or at least 20 nucleotides, or at least 25 nucleotides, or at least 30 nucleotides, or at least 40 nucleotides, or most preferably at least 50 nucleotides), or at least 25% (more preferably at least 50%, or at least 60%, or at least 70%, and most preferably at least 80%) of the length of the nucleic acid of the present invention to which it hybridizes, and has at least 60% sequence identity (more preferably at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99%, and most preferably at least 99.5%) with the nucleic acid of the present invention to which it hybridizes, where sequence identity is determined by comparing the sequences of the hybridizing nucleic acids when aligned so as to maximize overlap and identity while minimizing sequence gaps as described in more detail above.

Variants are ordinarily prepared by site specific mutagenesis of nucleotides in the DNA encoding the polypeptide, using cassette or PCR mutagenesis or other techniques well known in the art, to produce DNA encoding the variant, and thereafter expressing the recombinant DNA in cell culture as outlined herein. However, antibodies or antibody fragments comprising variant CDRs having up to about 100-150 residues may be prepared by in vitro synthesis using established techniques. The variants typically exhibit the same qualitative biological activity as the naturally occurring analogue, e.g., binding to antigen, although variants can also be selected which have modified characteristics as will be more fully outlined herein.

As will be appreciated by those in the art, due to the degeneracy of the genetic code, an extremely large number of nucleic acids may be made, all of which encode the CDRs (and heavy and light chains or other components of a heterodimeric antibody described herein) of the invention. Thus, having identified a particular amino acid sequence, those skilled in the art could make any number of different nucleic acids, by simply modifying the sequence of one or more codons in a way which does not change the amino acid sequence of the encoded protein.

The invention also provides expression systems and constructs in the form of plasmids, expression vectors, transcription or expression cassettes which comprise at least one polynucleotide as above. In addition, the invention provides host cells comprising such expression systems or constructs.

Typically, expression vectors used in the host cells will contain sequences for plasmid maintenance and for cloning and expression of exogenous nucleotide sequences. Such sequences, collectively referred to as "flanking sequences," in certain embodiments will typically include one or more of the following nucleotide sequences: a promoter, one or more enhancer sequences, an origin of replication, a transcriptional termination sequence, a complete intron sequence containing a donor and acceptor splice site, a sequence encoding a leader sequence for polypeptide secretion, a ribosome binding site, a polyadenylation sequence, a polylinker region for inserting the nucleic acid encoding the polypeptide to be expressed, and a selectable marker element. Each of these sequences is discussed below.

Optionally, the vector may contain a "tag"-encoding sequence, i.e., an oligonucleotide molecule located at the 5' or 3' end of the polypeptide coding sequence; the oligonucleotide sequence encodes polyHis (such as hexaHis), or another "tag" such as FLAG, HA (hemaglutinin influenza virus), or myc, for which commercially available antibodies exist. This tag is typically fused to the polypeptide upon expression of the polypeptide, and can serve as a means for affinity purification or detection of the polypeptide from the host cell. Affinity purification can be accomplished, for example, by column chromatography using antibodies against the tag as an affinity matrix. Optionally, the tag can subsequently be removed from the purified polypeptide by various means such as using certain peptidases for cleavage.

Flanking sequences may be homologous (i.e., from the same species and/or strain as the host cell), heterologous (i.e., from a species other than the host cell species or strain), hybrid (i.e., a combination of flanking sequences from more than one source), synthetic or native. As such, the source of a flanking sequence may be any prokaryotic or eukaryotic organism, any vertebrate or invertebrate organism, or any plant, provided that the flanking sequence is functional in, and can be activated by, the host cell machinery.

Flanking sequences useful in the vectors of this invention may be obtained by any of several methods well known in the art. Typically, flanking sequences useful herein will have been previously identified by mapping and/or by restriction endonuclease digestion and can thus be isolated from the proper tissue source using the appropriate restriction endonucleases. In some cases, the full nucleotide sequence of a flanking sequence may be known. Here, the flanking sequence may be synthesized using the methods described herein for nucleic acid synthesis or cloning.

Whether all or only a portion of the flanking sequence is known, it may be obtained using polymerase chain reaction (PCR) and/or by screening a genomic library with a suitable probe such as an oligonucleotide and/or flanking sequence fragment from the same or another species. Where the flanking sequence is not known, a fragment of DNA containing a flanking sequence may be isolated from a larger piece of DNA that may contain, for example, a coding sequence or even another gene or genes. Isolation may be accomplished by restriction endonuclease digestion to produce the proper DNA fragment followed by isolation using agarose gel purification, Qiagen® column chromatography (Chatsworth, Calif.), or other methods known to the skilled artisan. The selection of suitable enzymes to accomplish this purpose will be readily apparent to one of ordinary skill in the art.

An origin of replication is typically a part of those prokaryotic expression vectors purchased commercially, and the origin aids in the amplification of the vector in a host cell. If the vector of choice does not contain an origin of replication site, one may be chemically synthesized based on a known sequence, and ligated into the vector. For example, the origin of replication from the plasmid pBR322 (New England Biolabs, Beverly, Mass.) is suitable for most gram-negative bacteria, and various viral origins (e.g., SV40, polyoma, adenovirus, vesicular stomatitus virus (VSV), or papillomaviruses such as HPV or BPV) are useful for cloning vectors in mammalian cells. Generally, the origin of replication component is not needed for mammalian expression vectors (for example, the SV40 origin is often used only because it also contains the virus early promoter).

A transcription termination sequence is typically located 3' to the end of a polypeptide coding region and serves to terminate transcription. Usually, a transcription termination sequence in prokaryotic cells is a G-C rich fragment followed by a poly-T sequence. While the sequence is easily cloned from a library or even purchased commercially as part of a vector, it can also be readily synthesized using methods for nucleic acid synthesis such as those described herein.

A selectable marker gene encodes a protein necessary for the survival and growth of a host cell grown in a selective culture medium. Typical selection marker genes encode proteins that (a) confer resistance to antibiotics or other toxins, e.g., ampicillin, tetracycline, or kanamycin for prokaryotic host cells; (b) complement auxotrophic deficiencies of the cell; or (c) supply critical nutrients not available from complex or defined media. Specific selectable markers are the kanamycin resistance gene, the ampicillin resistance gene, and the tetracycline resistance gene. Advantageously, a neomycin resistance gene may also be used for selection in both prokaryotic and eukaryotic host cells.

Other selectable genes may be used to amplify the gene that will be expressed. Amplification is the process wherein genes that are required for production of a protein critical for growth or cell survival are reiterated in tandem within the chromosomes of successive generations of recombinant cells. Examples of suitable selectable markers for mammalian cells include dihydrofolate reductase (DHFR) and promoterless thymidine kinase genes. Mammalian cell transformants are placed under selection pressure wherein only the transformants are uniquely adapted to survive by virtue of the selectable gene present in the vector. Selection pressure is imposed by culturing the transformed cells under conditions in which the concentration of selection agent in the medium is successively increased, thereby leading to the amplification of both the selectable gene and the DNA that encodes another gene, such as an antibody light or heavy chain. As a result, increased quantities of a polypeptide are synthesized from the amplified DNA.

A ribosome-binding site is usually necessary for translation initiation of mRNA and is characterized by a Shine-Dalgarno sequence (prokaryotes) or a Kozak sequence (eukaryotes). The element is typically located 3' to the promoter and 5' to the coding sequence of the polypeptide to be expressed. In certain embodiments, one or more coding regions may be operably linked to an internal ribosome binding site (IRES), allowing translation of two open reading frames from a single RNA transcript.

In some cases, such as where glycosylation is desired in a eukaryotic host cell expression system, one may manipulate the various pre- or prosequences to improve glycosylation or yield. For example, one may alter the peptidase cleavage site of a particular signal peptide, or add prosequences, which also may affect glycosylation. The final protein product may have, in the −1 position (relative to the first amino acid of the mature protein) one or more additional amino acids incident to expression, which may not have been totally removed. For example, the final protein product may have one or two amino acid residues found in the peptidase cleavage site, attached to the amino-terminus. Alternatively, use of some enzyme cleavage sites may result in a slightly truncated form of the desired polypeptide, if the enzyme cuts at such area within the mature polypeptide.

Expression and cloning vectors of the invention will typically contain a promoter that is recognized by the host organism and operably linked to the molecule encoding the polypeptide. Promoters are untranscribed sequences located upstream (i.e., 5') to the start codon of a structural gene (generally within about 100 to 1000 bp) that control transcription of the structural gene. Promoters are conventionally grouped into one of two classes: inducible promoters and constitutive promoters. Inducible promoters initiate increased levels of transcription from DNA under their control in response to some change in culture conditions, such as the presence or absence of a nutrient or a change in temperature. Constitutive promoters, on the other hand, uniformly transcribe gene to which they are operably linked, that is, with little or no control over gene expression. A large number of promoters, recognized by a variety of potential host cells, are well known. A suitable promoter is operably linked to the DNA encoding e.g., heavy chain or light chain, by removing the promoter from the source DNA by restriction enzyme digestion and inserting the desired promoter sequence into the vector.

Suitable promoters for use with yeast hosts are also well known in the art. Yeast enhancers are advantageously used with yeast promoters. Suitable promoters for use with mammalian host cells are well known and include, but are not limited to, those obtained from the genomes of viruses such as polyoma virus, fowlpox virus, adenovirus (such as Adenovirus 2), bovine papilloma virus, avian sarcoma virus, cytomegalovirus, retroviruses, hepatitis-B virus and most preferably Simian Virus 40 (SV40). Other suitable mammalian promoters include heterologous mammalian promoters, for example, heat-shock promoters and the actin promoter.

Additional promoters which may be of interest include, but are not limited to: SV40 early promoter (Benoist and Chambon, 1981, Nature 290:304-310); CMV promoter (Thomsen et al., 1984, Proc. Natl. Acad. U.S.A. 81:659-663); the promoter contained in the 3' long terminal repeat of Rous sarcoma virus (Yamamoto et al., 1980, Cell 22:787-797); herpes thymidine kinase promoter (Wagner et al., 1981, Proc. Natl. Acad. Sci. U.S.A. 78:1444-1445); promoter and regulatory sequences from the metallothionine gene Prinster et al., 1982, Nature 296:39-42); and prokaryotic promoters such as the beta-lactamase promoter (Villa-Kamaroff et al., 1978, Proc. Natl. Acad. Sci. U.S.A. 75:3727-3731); or the tac promoter (DeBoer et al., 1983, Proc. Natl. Acad. Sci. U.S.A. 80:21-25). Also of interest are the following animal transcriptional control regions, which exhibit tissue specificity and have been utilized in transgenic animals: the elastase I gene control region that is active in pancreatic acinar cells (Swift et al., 1984, Cell 38:639-646; Ornitz et al., 1986, Cold Spring Harbor Symp. Quant. Biol. 50:399-409; MacDonald, 1987, Hepatology 7:425-515); the insulin gene control region that is active in pancreatic beta cells (Hanahan, 1985, Nature 315:115-122); the immunoglobulin gene control region that is active in lymphoid cells (Grosschedl et al., 1984, Cell 38:647-658; Adames et al., 1985, Nature 318:533-538; Alexander et al., 1987, Mol. Cell. Biol. 7:1436-1444); the mouse mammary tumor virus control region that is active in testicular, breast, lymphoid and mast cells (Leder et al., 1986, Cell 45:485-495); the albumin gene control region that is active in liver (Pinkert et al., 1987, Genes and Devel. 1:268-276); the alpha-fetoprotein gene control region that is active in liver (Krumlauf et al., 1985, Mol. Cell. Biol. 5:1639-1648; Hammer et al., 1987, Science 253:53-58); the alpha 1-antitrypsin gene control region that is active in liver (Kelsey et al., 1987, Genes and Devel. 1:161-171); the beta-globin gene control region that is active in myeloid cells (Mogram et al., 1985, Nature 315:338-340; Kollias et al., 1986, Cell 46:89-94); the myelin basic protein gene control region that is active in oligodendrocyte cells in the brain (Readhead et al., 1987, Cell 48:703-712); the myosin light chain-2 gene control region that is active in skeletal muscle (Sani, 1985, Nature 314:283-286); and the gonadotropic releasing hormone gene control region that is active in the hypothalamus (Mason et al., 1986, Science 234:1372-1378).

An enhancer sequence may be inserted into the vector to increase transcription of DNA encoding light chain or heavy chain of the invention by higher eukaryotes. Enhancers are cis-acting elements of DNA, usually about 10-300 bp in length, that act on the promoter to increase transcription. Enhancers are relatively orientation and position independent, having been found at positions both 5' and 3' to the transcription unit. Several enhancer sequences available from mammalian genes are known (e.g., globin, elastase, albumin, alpha-feto-protein and insulin). Typically, however, an enhancer from a virus is used. The SV40 enhancer, the cytomegalovirus early promoter enhancer, the polyoma enhancer, and adenovirus enhancers known in the art are exemplary enhancing elements for the activation of eukaryotic promoters. While an enhancer may be positioned in the vector either 5' or 3' to a coding sequence, it is typically located at a site 5' from the promoter. A sequence encoding an appropriate native or heterologous signal sequence (leader sequence or signal peptide) can be incorporated into an expression vector, to promote extracellular secretion of the antibody. The choice of signal peptide or leader depends on the type of host cells in which the antibody is to be produced, and a heterologous signal sequence can replace the native signal sequence. Examples of signal peptides that are functional in mammalian host cells include the following: the signal sequence for interleukin-7 (IL-7) described in U.S. Pat. No. 4,965,195; the signal sequence for interleukin-2 receptor described in Cosman et al., 1984, Nature 312:768; the interleukin-4 receptor signal peptide described in EP Patent No. 0367 566; the type I interleukin-1 receptor signal peptide described in U.S. Pat. No. 4,968,607; the type II interleukin-1 receptor signal peptide described in EP Patent No. 0 460 846.

The vector may contain one or more elements that facilitate expression when the vector is integrated into the host cell genome. Examples include an EASE element (Aldrich et al. 2003 Biotechnol Prog. 19:1433-38) and a matrix attachment region (MAR). MARs mediate structural organization of the chromatin and may insulate the integrated vactor from "position" effect. Thus, MARs are particularly useful when the vector is used to create stable transfectants. A number of natural and synthetic MAR-containing nucleic acids are known in the art, e.g., U.S. Pat. Nos. 6,239,328; 7,326,567; 6,177,612; 6,388,066; 6,245,974; 7,259,010; 6,037,525; 7,422,874; 7,129,062.

Expression vectors of the invention may be constructed from a starting vector such as a commercially available vector. Such vectors may or may not contain all of the desired flanking sequences. Where one or more of the flanking sequences described herein are not already present in the vector, they may be individually obtained and ligated into the vector. Methods used for obtaining each of the flanking sequences are well known to one skilled in the art.

After the vector has been constructed and a nucleic acid molecule encoding light chain, a heavy chain, or a light chain and a heavy chain sequence has been inserted into the proper site of the vector, the completed vector may be inserted into a suitable host cell for amplification and/or polypeptide expression. The transformation of an expression vector into a selected host cell may be accomplished by well known methods including transfection, infection, calcium phosphate co-precipitation, electroporation, microinjection, lipofection, DEAE-dextran mediated transfection, or other known techniques. The method selected will in part be a function of the type of host cell to be used. These methods and other suitable methods are well known to the skilled artisan, and are set forth, for example, in Sambrook et al., 2001, supra.

A host cell, when cultured under appropriate conditions, synthesizes heterodimeric antibody that can subsequently be collected from the culture medium (if the host cell secretes it into the medium) or directly from the host cell producing it (if it is not secreted). The selection of an appropriate host cell will depend upon various factors, such as desired expression levels, polypeptide modifications that are desirable or necessary for activity (such as glycosylation or phosphorylation) and ease of folding into a biologically active molecule. A host cell may be eukaryotic or prokaryotic.

Mammalian cell lines available as hosts for expression are well known in the art and include, but are not limited to, immortalized cell lines available from the American Type Culture Collection (ATCC) and any cell lines used in an expression system known in the art can be used to make the recombinant polypeptides of the invention. In general, host cells are transformed with a recombinant expression vector that comprises DNA encoding a desired heterodimeric antibody. Among the host cells that may be employed are prokaryotes, yeast or higher eukaryotic cells. Prokaryotes include gram negative or gram positive organisms, for example $E. coli$ or bacilli. Higher eukaryotic cells include insect cells and established cell lines of mammalian origin. Examples of suitable mammalian host cell lines include the COS-7line of monkey kidney cells (ATCC CRL 1651) (Gluzman et al., 1981, Cell 23:175), L cells, 293 cells, C127 cells, 3T3 cells (ATCC CCL 163), Chinese hamster ovary (CHO) cells, or their derivatives such as Veggie CHO and related cell lines which grow in serum-free media (Rasmussen et al., 1998, Cytotechnology 28: 31), HeLa cells, BHK (ATCC CRL 10) cell lines, and the CVI/EBNA cell line derived from the African green monkey kidney cell line CVI (ATCC CCL 70) as described by McMahan et al., 1991, EMBO J. 10: 2821, human embryonic kidney cells such as 293, 293 EBNA or MSR 293, human epidermal A431 cells, human Colo205 cells, other transformed primate cell lines, normal diploid cells, cell strains derived from in vitro culture of primary tissue, primary explants, HL-60, U937, HaK or Jurkat cells. Optionally, mammalian cell lines such as HepG2/3B, KB, NIH 3T3 or S49, for example, can be used for expression of the polypeptide when it is desirable to use the polypeptide in various signal transduction or reporter assays. Alternatively, it is possible to produce the polypeptide in lower eukaryotes such as yeast or in prokaryotes such as bacteria. Suitable yeasts include $Saccharomyces\ cerevisiae, Schizosaccharomyces\ pombe, Kluyveromyces$ strains, $Candida$, or any yeast strain capable of expressing heterologous polypeptides. Suitable bacterial strains include $Escherichia\ coli, Bacillus\ subtilis, Salmonella\ typhimurium$, or any bacterial strain capable of expressing heterologous polypeptides.

If the antibody or fragment is made in yeast or bacteria, it may be desirable to modify the product produced therein, for example by phosphorylation or glycosylation of the appropriate sites, in order to obtain a functional product. Such covalent attachments can be accomplished using known chemical or enzymatic methods. A polypeptide can also be produced by operably linking the isolated nucleic acid of the invention to suitable control sequences in one or more insect expression vectors, and employing an insect expression system. Materials and methods for baculovirus/insect cell expression systems are commercially available in kit form from, e.g., Invitrogen, San Diego, Calif., U.S.A.

(the MaxBac kit), and such methods are well known in the art, as described in Summers and Smith, Texas Agricultural Experiment Station Bulletin No. 1555 (1987), and Luckow and Summers, Bio/Technology 6:47 (1988). Cell-free translation systems could also be employed to produce polypeptides, such as antibodies or fragments, using RNAs derived from nucleic acid constructs disclosed herein. Appropriate cloning and expression vectors for use with bacterial, fungal, yeast, and mammalian cellular hosts are described by Pouwels et al. (Cloning Vectors: A Laboratory Manual, Elsevier, New York, 1985). A host cell that comprises an isolated nucleic acid of the invention, preferably operably linked to at least one expression control sequence, is a "recombinant host cell".

In certain embodiments, cell lines may be selected through determining which cell lines have high expression levels and constitutively produce antigen binding proteins with the desired binding properties. In another embodiment, a cell line from the B cell lineage that does not make its own antibody but has a capacity to make and secrete a heterologous antibody can be selected.

Therapeutic Methods

The heterodimeric antibody molecules described herein are useful for treating or preventing bone-related disorders, such as bone-related disorders associated with abnormal osteoblast or osteoclast activity. In some embodiments, the heterodimeric antibody is administered to a subject suffering from a bone related disorder selected from the group consisting of achondroplasia, cleidocranial dysostosis, enchondromatosis, fibrous dysplasia, Gaucher's Disease, hypophosphatemic rickets, Marfan's syndrome, multiple hereditary exotoses, neurofibromatosis, osteogenesis imperfecta, osteopetrosis, osteopoikilosis, sclerotic lesions, pseudoarthrosis, pyogenic osteomyelitis, periodontal disease, anti-epileptic drug induced bone loss, primary and secondary hyperparathyroidism, familial hyperparathyroidism syndromes, weightlessness induced bone loss, osteoporosis in men, postmenopausal bone loss, osteoarthritis, renal osteodystrophy, infiltrative disorders of bone, oral bone loss, osteonecrosis of the jaw, juvenile Paget's disease, melorheostosis, metabolic bone diseases, mastocytosis, sickle cell anemia/disease, organ transplant related bone loss, kidney transplant related bone loss, systemic lupus erythematosus, ankylosing spondylitis, epilepsy, juvenile arthritides, thalassemia, mucopolysaccharidoses, Fabry Disease, Turner Syndrome, Down Syndrome, Klinefelter Syndrome, leprosy, Perthe's Disease, adolescent idiopathic scoliosis, infantile onset multi-system inflammatory disease, Winchester Syndrome, Menkes Disease, Wilson's Disease, ischemic bone disease (such as Legg-Calve-Perthes disease and regional migratory osteoporosis), anemic states, conditions caused by steroids, glucocorticoid-induced bone loss, heparin-induced bone loss, bone marrow disorders, scurvy, malnutrition, calcium deficiency, osteoporosis, osteopenia, alcoholism, chronic liver disease, postmenopausal state, chronic inflammatory conditions, rheumatoid arthritis, inflammatory bowel disease, ulcerative colitis, inflammatory colitis, Crohn's disease, oligomenorrhea, amenorrhea, pregnancy-related bone loss, diabetes mellitus, hyperthyroidism, thyroid disorders, parathyroid disorders, Cushing's disease, acromegaly, hypogonadism, immobilization or disuse, reflex sympathetic dystrophy syndrome, regional osteoporosis, osteomalacia, bone loss associated with joint replacement, HIV associated bone loss, bone loss associated with loss of growth hormone, bone loss associated with cystic fibrosis, chemotherapy-associated bone loss, tumor-induced bone loss, cancer-related bone loss, hormone ablative bone loss, multiple myeloma, drug-induced bone loss, anorexia nervosa, disease-associated facial bone loss, disease-associated cranial bone loss, disease-associated bone loss of the jaw, disease-associated bone loss of the skull, bone loss associated with aging, facial bone loss associated with aging, cranial bone loss associated with aging, jaw bone loss associated with aging, skull bone loss associated with aging, and bone loss associated with space travel.

In some embodiments, the heterodimeric antibodies described herein are useful for improving outcomes in orthopedic procedures, dental procedures, implant surgery, joint replacement, bone grafting, bone cosmetic surgery and bone repair such as fracture healing, nonunion healing, delayed union healing and facial reconstruction. A composition comprising one or more heterodimeric antibodies or fragments may be administered before, during and/or after the procedure, replacement, graft, surgery or repair.

In some embodiments, the heterodimeric antibodies described herein are useful for the treatment of any fracture comprising a gap between two segments of bone (e.g., a gap of at least about 1 mm between two segments of bone). In some or any embodiments, the gap is at least about 2 mm, at least about 3 mm, at least about 4 mm, at least about 5 mm, at least about 6 mm, at least about 7 mm, at least about 8 mm, at least about 9 mm, or at least about 1 cm or more. In some or any embodiments, the gap is about 5 mm to 1 cm, or up to 1 cm. The terms "bone gap defect" and "segmental skeletal defect" are used synonymously herein and refer to a gap between two segments of bone (e.g., a gap of at least 1 mm).

Exemplary bone gap defects include, but are not limited to, a comminuted fracture, a non-union fracture, a segmental skeletal defect, surgically created bone defects, surgically treated bone defects, and bone defects created from traumatic injury to the bone or disease (including, but not limited to, arthritis, tumor removal (resection) or infection removal). In some or any embodiments, the bone gap defect is produced by removal of infected sections of bone or the removal of cancer from the bone due to bone cancers including, but not limited to, osteosarcoma, Ewing's sarcoma, chondrosarcoma, malignant fibrous histiocytoma, fibrosarcoma, and chordoma. In some or any embodiments, the bone gap defect is a developmental deformity, e.g., due to a genetic defect.

In some or any embodiments, the bone gap defect is produced by removal of sections of bone containing a benign tumor. Exemplary benign bone tumors include, but are not limited to, osteoma, osteoid osteoma, osteoblastoma, osteochondroma, enchondroma, chonrdomyxoid fibroma, aneurysmal bone cyst, unicameral bone cyst, fibrous dysplasia of bone and giant cell tumor of the bone.

Administration of the heterodimeric antibody enhances or accelerates bone gap defect healing, thereby "treating" the bone gap defect. "Enhancing" bone healing means mediating a level of bone healing beyond (i.e., greater than) the level of bone healing experienced in subjects (e.g., mammals, such as humans) not administered the sclerostin inhibitor (i.e., control subjects). Bone healing is evidenced by, for example, bridging status, improved bone volume, improved bone mineral content and density within the fracture gap (i.e., formation of bridging bone), mature bone callus, improved bone strength (optionally accompanied by a medically-acceptable level of bone stiffness), or improved patient use of the affected area. By "improved" is meant an increase or decrease (as desired) in the measured parameter. The increase can be a return, in whole or in part, of the measured parameter to baseline level (e.g., the level prior to the bone gap defect), to values provided in normative databases used in the art, or to the contralateral functional level (e.g., return, in whole or in part, to the functional capabilities of, for example, the contralateral limb). In some cases, the increase can be an improvement beyond baseline level. If desired, the measured parameters in patients administered one or more doses of the heterodimeric antibody can be compared to the same parameters in fracture patients (optionally age and gender matched) not administered the heterodimeric antibody to further analyze the efficacy of the methods described herein.

Formation of bridging bone, bone mineral content and bone density, and/or mature boney callus at the site of bone defect may be measured using radiography (e.g., radiographic absorptometry), single- and/or dual-energy X-ray absorptometry, quantitative computed tomography (QCT), ultrasonography, radiography (e.g., radiographic absorptometry), and magnetic resonance imaging. In some embodiments, the heterodimeric antibody may be administered at a dose and for a time period effective to increase bridging bone formation, formation of bony callus, or bone density (or volume) at the defect site by at least about 5% (about 6%, about 7%, about 8%, or about 9%). In some embodiments, bridging bone formation, formation of bony callus, or bone density at the defect site is increased by at least about 10% (e.g., at least about 10%, at least about 12%, at least about 15%, at least about 18%, at least about 20%, or at least about 22%). In other embodiments, bridging bone formation, formation of bony callus, or bone density at the defect site is increased by the sclerostin inhibitor at least about 25% (e.g., at least about 26% or at least about 28%). In yet other embodiments, bridging bone formation, formation of bony callus, or bone density at the defect site is increased at least about 30% (e.g., at least about 32%, at least about 35%, at least about 38%, or at least about 40%) or at least about 50% (e.g., at least about 60%, at least about 70%, at least about 80%, at least about 90%, or about 100%). The increase or re-establishment of bridging bone formation can be determined at 1 week, 2 weeks, 3 weeks, or 4 weeks following the initial administration of heterodimeric antibody. Alternatively, the bone density level can be determined after the treatment period ends (e.g., 1 week, 2 weeks, 3 weeks, or 4 weeks after the treatment period ends). In one aspect, the method reduces the amount of time required to establish a desired level of bone formation, bone volume, bony callus, or bone density (e.g., any percent increase in bone formation, bone mineral density, bony callus, or bone volume described herein) compared to age and gender-matched patients that do not receive the heterodimeric antibody, thereby reducing recovery time for a subject. For example, in one embodiment, the heyerodimeric antibody reduces the amount of time required to increase bone density or volume at the defect site at least about 10% (e.g., at least about 20%, at least about 25%, at least about 30%, at least about 35%, at least about 40%, at least about 45%, or at least about 50%).

The heterodimeric antibody need not cure the subject of the disorder or completely protect against the onset of a bone-related disorder to achieve a beneficial biological response. The heterodimeric antibody may be used prophylactically, meaning to protect, in whole or in part, against a bone-related disorder or symptom thereof. The heterodimeric antibody also may be used therapeutically to ameliorate, in whole or in part, a bone-related disorder or symptom thereof, or to protect, in whole or in part, against further progression of a bone-related disorder or symptom thereof. Indeed, the materials and methods of the invention are particularly useful for increasing bone mineral density and maintaining the increased bone mineral density over a period of time.

In some embodiments, one or more administrations of a heterodimeric antibody described herein are carried out over a therapeutic period of, for example, about 1 week to about 18 months (e.g., about 1 month to about 12 months, about 1 month to about 9 months or about 1 month to about 6 months or about 1 month to about 3 months). In some embodiments, a subject is administered one or more doses of a heterodimeric antibody described herein over a therapeutic period of, for example about 1 month to about 12 months (52 weeks) (e.g., about 2 months, about 3 months, about 4 months, about 5 months, about 6 months, about 7 months, about 8 months, about 9 months, about 10 months, or about 11 months). In some embodiments, a subject is administered one or more doses of the heterodimeric antibody to maintain bone mineral density. The term "maintain bone mineral density" as used herein means that the increased bone mineral density resulting from the initial dose of the heterodimeric antibody does not fall more than about 1% to about 5% over the course of about 6 months, about 9 months about 1 year, about 18 months, about 2 years, or over the course of the patient's life). It will be appreciated that a patient can require alternate treatment phases for increasing bone density and maintaining bone density.

In addition, it may be advantageous to administer multiple doses of the heterodimeric antibody or space out the administration of doses, depending on the therapeutic regimen selected for a particular subject. In some embodiments, the heterodimeric antibody or fragment thereof is administered periodically over a time period of one year (12 months, 52 weeks) or less (e.g., 9 months or less, 6 months or less, or 3 months or less). In this regard, the heterodimeric antibody or fragment thereof is administered to the human once every about 3 days, or about 7 days, or 2 weeks, or 3 weeks, or 4 weeks, or 5 weeks, or 6 weeks, or 7 weeks, or 8 weeks, or 9 weeks, or 10 weeks, or 11 weeks, or 12 weeks, or 13 weeks, or 14 weeks, or 15 weeks, or 16 weeks, or 17 weeks, or 18 weeks, or 19 weeks, or 20 weeks, or 21 weeks, or 22 weeks, or 23 weeks, or 6 months, or 12 months.

In some embodiments, the therapeutic period begins soon after a bone gap defect is detected, e.g., within 30 minutes, within 1 hour, within 2 hours, within 6 hours, within 12 hours or within 24 hours of the defect. In other embodiments, the inhibitor is administered within 1 day of the bone defect, within 3 days of the bone defect, within 5 days of the bone defect, within 7 days of the bone defect, or within two weeks of the bone defect, wherein the sclerostin binding agent is administered for a period of time that is at least 11 weeks post-bone defect (e.g., 11 weeks, 12 weeks, 13 weeks, 14 weeks, 15 weeks, 16 weeks, 17 weeks, 18 weeks 19 weeks, 20 weeks, 21 weeks, 22 weeks, 23 weeks, 24 weeks, 25 weeks, 26 weeks, 27 weeks 28 weeks, 29 weeks, 30 weeks, 31 weeks or longer (e.g., 8 months, 9 months, 10 months, 11 months, 1 year, 18 months or longer)).

In some embodiments, one or more doses of the heterodimeric antibody or fragment thereof are administered in an amount and for a time effective to treat a bone disorder associated with decreased bone mineral density. In various embodiments, one or more doses comprising from about 50 milligrams to about 1,000 milligrams of the heterodimeric antibody are administered per week to a subject (e.g., a human subject). For example, a dose of heterodimeric antibody can comprise at least about 5 mg, 15 mg, 25 mg, 50 mg, about 60 mg, about 70 mg, about 80 mg, about 90 mg, about 100 mg, about 120 mg, about 150 mg, about 200 mg, about 240 mg, about 250 mg, about 280 mg, about 300 mg, about 350 mg, about 400 mg, about 420 mg, about 450 mg, about 500 mg, about 550 mg, about 600 mg, about 650 mg, about 700 mg, about 750 mg, about 800 mg, about 850 mg, about 900 mg, about 950 mg or up to about 1,000 mg of heterodimeric antibody. Ranges between any and all of these endpoints are also contemplated, e.g. about 50 mg to about 80 mg, about 70 mg to about 140 mg, about 70 mg to about 270 mg, about 75 mg to about 100 mg, about 100 mg to about 150 mg, about 140 mg to about 210 mg, or about 150 mg to about 200 mg, or about 180 mg to about 270 mg, or about 280 to about 410 mg. The dose is administered at any interval, such as multiple times a week (e.g., twice or three times per week), once a week, once every two weeks, once every three weeks, or once every four weeks. In some or any embodiments, a dose of heterodimeric antibody ranging from about 120 mg to about 210 mg is administered twice a week. In some or any embodiments, a dose of about 140 mg of the heterodimeric antibody is administered twice a week.

In some embodiments, the one or more doses of heterodimeric antibody can comprise between about 0.1 to about 50 milligrams (e.g., between about 5 and about 50 milligrams), or about 1 to about 100 milligrams, of heterodimeric antibody per kilogram of body weight (mg/kg). For example, the dose of heterodimeric antibody may comprise at least about 0.1 mg/kg, 0.5 mg/kg, 1 mg/kg, about 2 mg/kg, about 3 mg/kg, about 4 mg/kg, about 5 mg/kg, about 6 mg/kg, about 7 mg/kg, about 8 mg/kg, about 9 mg/kg, about 10 mg/kg, about 20 mg/kg, about 25 mg/kg, about 26 mg/kg, about 27 mg/kg, about 28 mg/kg, about 29 mg/kg, about 30 mg/kg, about 31 mg/kg, about 32 mg/kg, about 33 mg/kg, about 34 mg/kg, about 35 mg/kg, about 36 mg/kg, about 37 mg/kg, about 38 mg/kg, about 39 mg/kg, about 40 mg/kg, about 41 mg/kg, about 42 mg/kg, about 43 mg/kg, about 44 mg/kg, about 45 mg/kg, about 46 mg/kg, about 47 mg/kg, about 48 mg/kg, or about 49 mg/kg, or about 50 mg/kg, about 55 mg/kg, about 60 mg/kg, about 65 mg/kg, about 70 mg/kg, about 75 mg/kg, about 80 mg/kg, about 85 mg/kg, about 90 mg/kg, about 95 mg/kg, or up to about 100 mg/kg. Ranges between any and all of these endpoints are also contemplated, e.g., about 1 mg/kg to about 3 mg/kg, about 1 mg/kg to about 5 mg/kg, about 1 mg/kg to about 8 mg/kb, about 3 mg/kg to about 8 mg·kg, about 1 mg/kg to about 10 mg/kg, about 1 mg/kg to about 20 mg/kg, about 1 mg/kg to about 40 mg/kg, about 5 mg/kg to about 30 mg/kg, or about 5 mg/kg to about 20 mg/kg.

Monitoring Therapy

Heterodimeric antibody-mediated increases in bone mineral content or bone density may be measured using single- and dual-energy X-ray absorptometry, ultrasound, computed tomography, radiography, and magnetic resonance imaging. The amount of bone mass may also be calculated from body weights or by using other methods (see Guinness-Hey, Metab. Bone Dis. Relat. Res., 5:177-181 (1984)). Animal models are used in the art for testing the effect of the pharmaceutical compositions and methods on, for example, parameters of bone loss, bone resorption, bone formation, bone strength, or bone mineralization that mimic conditions of human disease such as osteoporosis and osteopenia. Examples of such models include the ovariectomized rat model (Kalu, Bone and Mineral, 15:175-192 (1991); Frost and Jee, Bone and Mineral, 18:227-236 (1992); and Jee and Yao, J. Musculoskel. Neuron. Interact., 1:193-207 (2001)). The methods for measuring heterodimeric antibody activity described herein also may be used to determine the efficacy of other sclerostin inhibitors.

In humans, bone mineral density can be determined clinically using dual x-ray absorptiometry (DXA) of, for example, the hip and spine. Other techniques include quantitative computed tomography (QCT), ultrasonography, single-energy x-ray absorptiometry (SXA), and radiographic absorptiometry. Common central skeletal sites for measurement include the spine and hip; peripheral sites include the forearm, finger, wrist and heel. Except for ultrasonography, the American Medical Association notes that BMD techniques typically involve the use of x-rays and are based on the principle that attenuation of the radiation depends on thickness and composition of the tissues in the radiation path. All techniques involve the comparison of results to a normative database.

Alternatively, a physiological response to one or more sclerostin binding agents can be gauged by monitoring bone marker levels. Bone markers are products created during the bone remodeling process and are released by bone, osteoblasts, and/or osteoclasts. Fluctuations in bone resorption and/or bone formation "marker" levels imply changes in bone remodeling/modeling. The International Osteoporosis Foundation (IOF) recommends using bone markers to monitor bone density therapies (see, e.g., Delmas et al., Osteoporos Int., Suppl. 6:S2-17 (2000), incorporated herein by reference). Markers indicative of bone resorption (or osteoclast activity) include, for example, C-telopeptide (e.g., C-terminal telopeptide of type 1 collagen (CTX) or serum cross-linked C-telopeptide), N-telopeptide (N-terminal telopeptide of type 1 collagen (NTX)), deoxypyridinoline (DPD), pyridinoline, urinary hydroxyproline, galactosyl hydroxylysine, and tartrate-resistant acid phosphatase (e.g., serum tartrate-resistant acid phosphatase isoform 5b). Bone formation/mineralization markers include, but are not limited to, bone-specific alkaline phosphatase (BSAP), peptides released from N- and C-terminal extension of type I procollagen (P1NP, PICP), and osteocalcin (OstCa). Several kits are commercially-available to detect and quantify markers in clinical samples, such as urine and blood.

Combination Therapy

Treatment of a pathology by combining two or more agents that target the same pathogen or biochemical pathway or biological process sometimes results in greater efficacy and diminished side effects relative to the use of a therapeutically relevant dose of each agent alone. In some cases, the efficacy of the drug combination is additive (the efficacy of the combination is approximately equal to the sum of the effects of each drug alone), but in other cases the effect is synergistic (the efficacy of the combination is greater than the sum of the effects of each drug given alone). As used herein, the term "combination therapy" means that two or more agents are delivered in a simultaneous manner, e.g., concurrently, or wherein one of the agents is administered first, followed by the second agent, e.g., sequentially.

In some embodiments, the heterodimeric antibody is administered along with a standard of care therapeutic for the treatment of decreased bone mineral density (i.e., the heterodimeric antibody and standard of care therapeutic are part of the same treatment plan). As used herein, the term "standard of care" refers to a treatment that is generally accepted by clinicians for a certain type of patient diagnosed with a type of illness. In some embodiments, the heterodimeric antibody is administered along with a second bone-enhancing agent useful for the treatment of decreased bone mineral density or bone defect. In some embodiments, the bone-enhancing agent is selected from the group consisting of an anti-resorptive agent, a bone-forming agent (i.e., anabolic), an estrogen receptor modulator (including, but not limited to, raloxifene, bazedoxifene and lasofoxifene) and a drug that has an inhibitory effect on osteoclasts. In some embodiments, the second bone-enhancing agent is selected from the group consisting of a bisphosphonate (including, but not limited to, alendronate sodium (FOSAMAX®), risedronate, ibandronate sodium (BONIVA®) and zoledronic acid (RECLAST®)); an estrogen or estrogen analogue; an anti-RANK ligand (RANKL) inhibitor, such as an anti-RANKL antibody (e.g., PROLIA®); vitamin D, or a vitamin D derivative or mimic thereof; a calcium source, a cathepsin-K (cat-K) inhibitor (e.g. odanacatib), Tibolone, calcitonin or a calcitriol; and hormone replacement therapy. In some embodiments, the second bone-enhancing agent includes, but is not limited to, parathyroid hormone (PTH) or a peptide fragment thereof, PTH-related protein (PTHrp), bone morphogenetic protein, osteogenin, NaF, a PGE2 agonist, a statin, strontium ranelate, a sclerostin inhibitor (e.g., an anti-sclerostin antibody described in, for example, U.S. Pat. Nos. 7,592,429 or 7,872,106), and an anti-DKK1 antibody or inhibitor. In some embodiments, the second bone-enhancing agent is Forteo® (Teriparatide), Preotact®, or Protelos®. In some embodiments, the second bone-enhaiving agent comprises a bone morphogenetic protein (e.g., BMP-1, BMP-2, BMP-3, BMP-4, BMP-5, BMP-6, BMP-7, BMP-8, BMP-9, BMP-10, BMP-11, BMP-12, BMP-13, BMP-14 and/or BMP-15).

In some embodiments, the combination therapy employing a heterodimeric antibody described herein may precede or follow administration of additional therapeutic(s) (e.g., second bone-enhancing agent) by intervals ranging from minutes to weeks to months. For example, separate modalities are administered within about 24 hours of each other, e.g., within about 6-12 hours of each other, or within about 1-2 hours of each other, or within about 10-30 minutes of each other. In some situations, it may be desirable to extend the time period for treatment significantly, where several days (2, 3, 4, 5, 6 or 7 days) to several weeks (1, 2, 3, 4, 5, 6, 7 or 8 weeks) lapse between the respective administrations of different modalities. Repeated treatments with one or both agents/therapies of the combination therapy is specifically contemplated.

Maintenance Therapeutic Regimen

Also contemplated is the use of a second bone-enhancing agent and/or heterodimeric antibody described herein in a maintenance regimen to, e.g., prevent or slow the loss of bone mineral density. In this regard, a method or use described herein optionally comprises administering one or more amounts of a second bone-enhancing agent effective to maintain bone mineral density for a maintenance period of about 1 week to about 5 years after the treatment period with the heterodimeric antibody has ended. For example, in some embodiments, a method or use described herein comprises the administration of a second bone-enhancing agent to the subject for a maintenance period of about at least about 1 week, 2 weeks, 3 weeks, 4 weeks, 5 weeks, 6 weeks, 7 weeks, 8 weeks, 9 weeks, 10 weeks, 11 weeks, 12 weeks, 3 months, 13 weeks, 14 weeks, 15 weeks, 16 weeks, 4 months, 17 weeks, 18 weeks, 19 weeks, 20 weeks, 5 months, 21 weeks, 22 weeks, 23 weeks, 24 weeks, 6 months, 25 weeks, 26 weeks, 27 weeks 28 weeks, 7 months, 29 weeks, 30 weeks, 31 weeks or longer (e.g., 8 months, 9 months, 10 months, 11 months, 1 year, 15 months, 18 months, 2 years, 3 years, 4 years, 5 years or longer (e.g., over the lifetime of the subject). In some embodiments, the maintenance period is about 6-12 weeks. In some embodiments, the maintenance period is about 4-12 weeks, or about 1-3 months. In some embodiments, the maintenance period is about 12-20 weeks, or about 3-5 months. In some embodiments, the maintenance period is about 20-32 weeks, or about 5-8 months. In some embodiments, the maintenance period is about 24-36 weeks, or about 6-9 months. In some embodiments, the maintenance period is about 1 year, about 2 years, about 3 years, about 4 years, about 5 years or longer. "Maintaining" bone mineral density includes maintaining similar levels of bone mineral density parameters experienced in the subject that received the heterodimeric antibody treatment.

Similarly, a method or use described herein optionally comprises subsequently administering one or more amounts of a heterodimeric antibody effective to maintain bone mineral density for a maintenance period of at least about least about 1 week, 2 weeks, 3 weeks, 4 weeks, 5 weeks, 6 weeks, 7 weeks, 8 weeks, 9 weeks, 10 weeks, 11 weeks, 12 weeks, 3 months, 13 weeks, 14 weeks, 15 weeks, 16 weeks, 4 months, 17 weeks, 18 weeks, 19 weeks, 20 weeks, 5 months, 21 weeks, 22 weeks, 23 weeks, 24 weeks, 6 months, 1 year, 2 years, 3 years, 4 years, 5 years or longer (e.g., over the lifetime of the subject) after the treatment period has ended. In some embodiments, the maintenance period is about 6-12 weeks. In some embodiments, the maintenance period is about 4-12 weeks, or about 1-3 months. In some embodiments, the maintenance period is about 12-20 weeks, or about 3-5 months. In some embodiments, the maintenance period is about 20-32 weeks, or about 5-8 months. In some embodiments, the maintenance period is about 24-36 weeks, or about 6-9 months. In some embodiments, the maintenance period is about 1 year, about 2 year, about 3 years, about 4 years, about 5 years or longer.

Pharmaceutical Compositions

In some embodiments, the invention provides a pharmaceutical composition comprising a therapeutically effective amount of one or a plurality of the antigen binding proteins of the invention together with a pharmaceutically effective diluents, carrier, solubilizer, emulsifier, preservative, and/or adjuvant. Pharmaceutical compositions of the invention include, but are not limited to, liquid, frozen, and lyophilized compositions.

Preferably, formulation materials are nontoxic to recipients at the dosages and concentrations employed. In specific embodiments, pharmaceutical compositions comprising a therapeutically effective amount of heterodimeric antibody or fragment are provided.

In some embodiments, the pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine, proline, or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. See, REMINGTON'S PHARMACEUTICAL SCIENCES, 18" Edition, (A. R. Genrmo, ed.), 1990, Mack Publishing Company.

In some embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the heterodimeric antibody or fragment. In certain embodiments, the primary vehicle or carrier in a pharmaceutical composition may be either aqueous or non-aqueous in nature. For example, a suitable vehicle or carrier may be water for injection, physiological saline solution or artificial cerebrospinal fluid, possibly supplemented with other materials common in compositions for parenteral administration. Neutral buffered saline or saline mixed with serum albumin are further exemplary vehicles. In specific embodiments, pharmaceutical compositions comprise Tris buffer of about pH 7.0-8.5, or acetate buffer of about pH 4.0-5.5, and may further include sorbitol or a suitable substitute therefor. In certain embodiments of the invention, the composition may be prepared for storage by mixing the selected composition having the desired degree of purity with optional formulation agents (REMINGTON'S PHARMACEUTICAL SCIENCES, supra) in the form of a lyophilized cake or an aqueous solution. Further, in some embodiments, the heterodimeric antibody or fragment may be formulated as a lyophilizate using appropriate excipients such as sucrose.

The pharmaceutical compositions of the invention can be selected for parenteral delivery. Alternatively, the compositions may be selected for inhalation or for delivery through the digestive tract, such as orally. Preparation of such pharmaceutically acceptable compositions is within the skill of the art. The formulation components are present preferably in concentrations that are acceptable to the site of administration. In certain embodiments, buffers are used to maintain the composition at physiological pH or at a slightly lower pH, typically within a pH range of from about 5 to about 8.

When parenteral administration is contemplated, the therapeutic compositions for use in this invention may be provided in the form of a pyrogen-free, parenterally acceptable aqueous solution comprising the desired heterodimeric antibody or fragment in a pharmaceutically acceptable vehicle. A particularly suitable vehicle for parenteral injection is sterile distilled water in which the heterodimeric antibody or fragment is formulated as a sterile, isotonic solution, properly preserved. In certain embodiments, the preparation involves the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired heterodimeric antibody or fragment.

Pharmaceutical compositions of the invention can be formulated for inhalation. In these embodiments, heterodimeric antibody or fragment is advantageously formulated as a dry, inhalable powder. In specific embodiments, heterodimeric antibody or fragment inhalation solutions may also be formulated with a propellant for aerosol delivery. In certain embodiments, solutions may be nebulized. Pulmonary administration and formulation methods therefore are further described in International Patent Application No. PCT/US94/001875, which is incorporated by reference and describes pulmonary delivery of chemically modified proteins.

It is also contemplated that formulations can be administered orally. Heterodimeric antibody or fragments that are administered in this fashion can be formulated with or without carriers customarily used in the compounding of solid dosage forms such as tablets and capsules. In certain embodiments, a capsule may be designed to release the active portion of the formulation at the point in the gastrointestinal tract when bioavailability is maximized and pre-systemic degradation is minimized. Additional agents can be included to facilitate absorption of the heterodimeric antibody or fragment. Diluents, flavorings, low melting point waxes, vegetable oils, lubricants, suspending agents, tablet disintegrating agents, and binders may also be employed.

Additional pharmaceutical compositions will be evident to those skilled in the art, including formulations involving antigen binding proteins in sustained- or controlled-delivery formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which is incorporated by reference and describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP058481, each of which is incorporated by reference), copolymers of L-glutamic acid and gamma ethyl-L-glutamate (Sidman et al., 1983, Biopolymers 2:547-556), poly (2-hydroxyethyl-methacrylate) (Langer et al., 1981, J. Biomed. Mater. Res. 15:167-277 and Langer, 1982, Chem. Tech. 12:98-105), ethylene vinyl acetate (Langer et al., 1981, supra) or poly-D(-)-3-hydroxybutyric acid (European Patent Application Publication No. EP133988). Sustained release compositions may also include liposomes that can be prepared by any of several methods known in the art. See, e.g., Eppstein et al., 1985, Proc. Natl. Acad. Sci. U.S.A. 82:3688-3692; European Patent Application Publication Nos. EP036676; EP088046 and EP143949, incorporated by reference.

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

Aspects of the invention includes self-buffering heterodimeric antibody or fragment formulations, which can be used as pharmaceutical compositions, as described in international patent application WO 2006/138181A2 (PCT/US2006/022599), which is incorporated by reference in its entirety herein.

As discussed above, certain embodiments provide heterodimeric antibody or fragment compositions, particularly pharmaceutical heterodimeric antibody or fragment compositions, that comprise, in addition to the heterodimeric antibody or fragment, one or more excipients such as those illustratively described in this section and elsewhere herein. Excipients can be used in the invention in this regard for a wide variety of purposes, such as adjusting physical, chemical, or biological properties of formulations, such as adjustment of viscosity, and or processes of the invention to improve effectiveness and or to stabilize such formulations and processes against degradation and spoilage due to, for instance, stresses that occur during manufacturing, shipping, storage, pre-use preparation, administration, and thereafter.

A variety of expositions are available on protein stabilization and formulation materials and methods useful in this regard, such as Arakawa et al., "Solvent interactions in pharmaceutical formulations," Pharm Res. 8(3): 285-91 (1991); Kendrick et al., "Physical stabilization of proteins in aqueous solution," in: RATIONAL DESIGN OF STABLE PROTEIN FORMULATIONS: THEORY AND PRACTICE, Carpenter and Manning, eds. Pharmaceutical Biotechnology. 13: 61-84 (2002), and Randolph et al., "Surfactant-protein interactions," Pharm Biotechnol. 13: 159-75 (2002), each of which is herein incorporated by reference in its entirety, particularly in parts pertinent to excipients and processes of the same for self-buffering protein formulations in accordance with the current invention, especially as to protein pharmaceutical products and processes for veterinary and/or human medical uses.

Salts may be used in accordance with certain embodiments of the invention to, for example, adjust the ionic strength and/or the isotonicity of a formulation and/or to improve the solubility and/or physical stability of a protein or other ingredient of a composition in accordance with the invention.

As is well known, ions can stabilize the native state of proteins by binding to charged residues on the protein's surface and by shielding charged and polar groups in the protein and reducing the strength of their electrostatic interactions, attractive, and repulsive interactions. Ions also can stabilize the denatured state of a protein by binding to, in particular, the denatured peptide linkages (—CONH) of the protein. Furthermore, ionic interaction with charged and polar groups in a protein also can reduce intermolecular electrostatic interactions and, thereby, prevent or reduce protein aggregation and insolubility.

Ionic species differ significantly in their effects on proteins. A number of categorical rankings of ions and their effects on proteins have been developed that can be used in formulating pharmaceutical compositions in accordance with the invention. One example is the Hofmeister series, which ranks ionic and polar non-ionic solutes by their effect on the conformational stability of proteins in solution. Stabilizing solutes are referred to as "kosmotropic." Destabilizing solutes are referred to as "chaotropic." Kosmotropes commonly are used at high concentrations (e.g., >1 molar ammonium sulfate) to precipitate proteins from solution ("salting-out"). Chaotropes commonly are used to denture and/or to solubilize proteins ("salting-in"). The relative effectiveness of ions to "salt-in" and "salt-out" defines their position in the Hofmeister series.

Free amino acids can be used in heterodimeric antibody or fragment formulations in accordance with various embodiments of the invention as bulking agents, stabilizers, and antioxidants, as well as other standard uses. Lysine, proline, serine, and alanine can be used for stabilizing proteins in a formulation. Glycine is useful in lyophilization to ensure correct cake structure and properties. Arginine may be useful to inhibit protein aggregation, in both liquid and lyophilized formulations. Methionine is useful as an antioxidant.

Polyols include sugars, e.g., mannitol, sucrose, and sorbitol and polyhydric alcohols such as, for instance, glycerol and propylene glycol, and, for purposes of discussion herein, polyethylene glycol (PEG) and related substances. Polyols are kosmotropic. They are useful stabilizing agents in both liquid and lyophilized formulations to protect proteins from physical and chemical degradation processes. Polyols also are useful for adjusting the tonicity of formulations.

Among polyols useful in select embodiments of the invention is mannitol, commonly used to ensure structural stability of the cake in lyophilized formulations. It ensures structural stability to the cake. It is generally used with a lyoprotectant, e.g., sucrose. Sorbitol and sucrose are among preferred agents for adjusting tonicity and as stabilizers to protect against freeze-thaw stresses during transport or the preparation of bulks during the manufacturing process. Reducing sugars (which contain free aldehyde or ketone groups), such as glucose and lactose, can glycate surface lysine and arginine residues. Therefore, they generally are not among preferred polyols for use in accordance with the invention. In addition, sugars that form such reactive species, such as sucrose, which is hydrolyzed to fructose and glucose under acidic conditions, and consequently engenders glycation, also is not among preferred polyols of the invention in this regard. PEG is useful to stabilize proteins and as a cryoprotectant and can be used in the invention in this regard.

Embodiments of the heterodimeric antibody or fragment formulations further comprise surfactants. Protein molecules may be susceptible to adsorption on surfaces and to denaturation and consequent aggregation at air-liquid, solid-liquid, and liquid-liquid interfaces. These effects generally scale inversely with protein concentration. These deleterious interactions generally scale inversely with protein concentration and typically are exacerbated by physical agitation, such as that generated during the shipping and handling of a product.

Surfactants routinely are used to prevent, minimize, or reduce surface adsorption. Useful surfactants in the invention in this regard include polysorbate 20, polysorbate 80, other fatty acid esters of sorbitan polyethoxylates, and poloxamer 188.

Surfactants also are commonly used to control protein conformational stability. The use of surfactants in this regard is protein-specific since, any given surfactant typically will stabilize some proteins and destabilize others.

Polysorbates are susceptible to oxidative degradation and often, as supplied, contain sufficient quantities of peroxides to cause oxidation of protein residue side-chains, especially methionine. Consequently, polysorbates should be used carefully, and when used, should be employed at their lowest effective concentration. In this regard, polysorbates exemplify the general rule that excipients should be used in their lowest effective concentrations.

Embodiments of heterodimeric antibody or fragment formulations further comprise one or more antioxidants. To some extent deleterious oxidation of proteins can be prevented in pharmaceutical formulations by maintaining proper levels of ambient oxygen and temperature and by avoiding exposure to light. Antioxidant excipients can be used as well to prevent oxidative degradation of proteins. Among useful antioxidants in this regard are reducing agents, oxygen/free-radical scavengers, and chelating agents. Antioxidants for use in therapeutic protein formulations in accordance with the invention preferably are water-soluble and maintain their activity throughout the shelf life of a product. EDTA is a preferred antioxidant in accordance with the invention in this regard.

Formulations in accordance with the invention may include metal ions that are protein co-factors and that are necessary to form protein coordination complexes, such as zinc necessary to form certain insulin suspensions. Metal ions also can inhibit some processes that degrade proteins. However, metal ions also catalyze physical and chemical processes that degrade proteins.

Magnesium ions (10-120 mM) can be used to inhibit isomerization of aspartic acid to isoaspartic acid. $Ca^{+2}$ ions (up to 100 mM) can increase the stability of human deoxyribonuclease. $Mg^{+2}$, $Mn^{+2}$, and $Zn^{+2}$, however, can destabilize rhDNase. Similarly, $Ca^{+2}$ and $Sr^{+2}$ can stabilize Factor VIII, it can be destabilized by $Mg^{+2}$, $Mn^{+2}$ and $Zn^{+2}$, $Cu^{+2}$ and $Fe^{+2}$, and its aggregation can be increased by Al+3 ions.

Embodiments of the heterodimeric antibody or fragment formulations further comprise one or more preservatives. Preservatives are necessary when developing multi-dose parenteral formulations that involve more than one extraction from the same container. Their primary function is to inhibit microbial growth and ensure product sterility throughout the shelf-life or term of use of the drug product. Commonly used preservatives include benzyl alcohol, phenol and m-cresol. Although preservatives have a long history of use with small-molecule parenterals, the development of protein formulations that includes preservatives can be challenging. Preservatives almost always have a destabilizing effect (aggregation) on proteins, and this has become a major factor in limiting their use in multi-dose protein formulations. To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations. At least four such pen devices containing preserved formulations of hGH are currently available on the market. Norditropin (liquid, Novo Nordisk), Nutropin AQ (liquid, Genentech) & Genotropin (lyophilized—dual chamber cartridge, Pharmacia & Upjohn) contain phenol while Somatrope (Eli Lilly) is formulated with m-cresol.

Several aspects need to be considered during the formulation and development of preserved dosage forms. The effective preservative concentration in the drug product must be optimized. This requires testing a given preservative in the dosage form with concentration ranges that confer anti-microbial effectiveness without compromising protein stability.

As might be expected, development of liquid formulations containing preservatives are more challenging than lyophilized formulations. Freeze-dried products can be lyophilized without the preservative and reconstituted with a preservative containing diluent at the time of use. This shortens the time for which a preservative is in contact with the protein, significantly minimizing the associated stability risks. With liquid formulations, preservative effectiveness and stability should be maintained over the entire product shelf-life (about 18 to 24 months). An important point to note is that preservative effectiveness should be demonstrated in the final formulation containing the active drug and all excipient components.

Heterodimeric antibody or fragment formulations generally will be designed for specific routes and methods of administration, for specific administration dosages and frequencies of administration, for specific treatments of specific diseases, with ranges of bio-availability and persistence, among other things. Formulations thus may be designed in accordance with the invention for delivery by any suitable route, including but not limited to orally, aurally, opthalmically, rectally, and vaginally, and by parenteral routes, including intravenous and intraarterial injection, intramuscular injection, and subcutaneous injection.

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration. The invention also provides kits for producing a single-dose administration unit. The kits of the invention may each contain both a first container having a dried protein and a second container having an aqueous formulation. In certain embodiments of this invention, kits containing single and multi-chambered pre-filled syringes (e.g., liquid syringes and lyosyringes) are provided.

The therapeutically effective amount of an antigen binding protein-containing pharmaceutical composition to be employed will depend, for example, upon the therapeutic context and objectives. One skilled in the art will appreciate that the appropriate dosage levels for treatment will vary depending, in part, upon the molecule delivered, the indication(s) for which the antigen binding protein is being used, the route of administration, and the size (body weight, body surface or organ size) and/or condition (the age and general health) of the patient. In certain embodiments, the clinicians may titer the dosage and modify the route of administration to obtain the optimal therapeutic effect.

Stability

The terms "stability" and "stable" as used herein in the context of a composition comprising a heterodimeric antibody (or antigen binding fragment thereof) refer to the resistance of the heterodimeric antibody (or antigen binding fragment thereof) in the composition to aggregation, degradation or fragmentation under given manufacture, preparation, transportation and/or storage conditions. Antibody formulations comprising a high degree of stability demonstrate enhanced reliability and safety and, as such, are advantageous for clinical use.

Antibody stability in a composition is optionally assessed by examining a desired parameter of the antibody in the composition (e.g., aggregation, degradation of heavy and/or light chains, chemical modification, etc.) over time. In this regard, a parameter is typically examined at an initial time point (T0) and an assessment time point (T1), optionally while exposing the antibody or fragment thereof to any of a number of environmental conditions, and compared. An initial time point can be, for instance, the time that the antibody or fragment thereof is first formulated in a composition or first examined for quality (i.e., examined to determine whether the antibody composition meets regulatory or manufacturing specifications with respect to aggregation or degradation). An initial time point also can be the time at which the antibody or antibody fragment is reformulated in a composition (e.g., reformulated at a higher or lower concentration compared to an initial preparation). An assessment time point is, in various embodiments, about 1 week (or about 2 weeks, or about 3 weeks, or about 4 weeks, or about 5 weeks, or about 6 weeks, or about 7 weeks, or about 8 weeks, or about 10 weeks, or about 3 months, or about 6 months or about 1 year) after the initial time point. The desired parameter (e.g., aggregation or degradation) of the antibody or fragment thereof in the composition can be assessed under a variety of storage conditions, such as temperatures of −30° C., 4° C., 20° C. or 40° C., shaking, pH, storage in different container materials (e.g., glass vials, pre-filled syringes, etc.), and the like.

Exemplary methods for determining the degree of aggregation, and/or types and/or sizes of aggregates present in a composition comprising the heterodimeric antibody include, but are not limited to, size exclusion chromatography (SEC), high performance size exclusion chromatography (HPSEC), static light scattering (SLS), Fourier Transform Infrared Spectroscopy (FTIR), circular dichroism (CD), urea-induced protein unfolding techniques, intrinsic tryptophan fluorescence, differential scanning calorimetry, and 1-anilino-8-naphthalenesulfonic acid (ANS) protein binding techniques. Size exclusion chromatography (SEC) may be performed to separate molecules on the basis of their size, by passing the molecules over a column packed with the appropriate resin, the larger molecules (e.g. aggregates) will elute before smaller molecules (e.g. monomers). The molecules are generally detected by UV absorbance at 280 nm and may be collected for further characterization. High pressure liquid chromatographic columns are often utilized for SEC analysis (HP-SEC). Alternatively, analytical ultracentrifugation (AUC) may be utilized. AUC is an orthogonal technique which determines the sedimentation coefficients (reported in Svedberg. S) of macromolecules in a liquid sample Like SEC, AUC is capable of separating and detecting antibody fragments/aggregates from monomers and is further able to provide information on molecular mass. Antibody or antibody fragment aggregation in a composition may also be characterized by particle counter analysis using a coulter counter or by turbidity measurements using a turbidimeter. Turbidity is a measure of the amount by which the particles in a solution scatter light and, thus, may be used as a general indicator of protein aggregation. In addition, non-reducing polyacrylamide gel electrophoresis (PAGE) or capillary gel electrophoresis (CGE) may be used to characterize the aggregation and/or fragmentation state of antibodies or antibody fragments in a composition.

Exemplary methods for determining antibody degradation include, but are not limited to, size-exclusion chromatography (SEC), sodium dodecyl sulfate-polyacrylamide gel electrophoresis (SDS-PAGE) and capillary electrophoresis with SDS (CE-SDS) and reversed phase HPLC with in-line MS detection.

In various embodiments, less than 5% of the heterodimeric antibody or antibody fragment described herein in the composition is in aggregate form under conditions of interest. For instance, less than 4%, or less than 3%, or less than 2%, or less than 1% of the heterodimeric antibody or fragment thereof in the composition is in aggregate form after storage at −30° C., 4° C., 20° C. or 40° C. for a period of about 1 week (or about 2 weeks, or about 3 weeks, or about 4 weeks, or about 5 weeks, or about 6 weeks, or about 7 weeks, or about 8 weeks, or about 10 weeks, or about 3 months, or about 6 months or about 1 year). In some embodiments, less than 5% (or less than 4% or less than 3% or less than 2% or less than 1% or less) of the heterodimeric antibody of antibody fragment described herein in the composition is in aggregate form after storage for two weeks at about 4° C.

For example at least 85% (or at least 90%, or at least 91%, or at least 92%, or at least 93%, or at least 94%, or at least 95%, or at least 96%, or at least 97%, or at least 98%, or at least 99%) of antibody or fragment thereof in a composition optionally is present in non-aggregate (i.e., monomeric) form after storage at −30° C., 4° C., 20° C. or 40° C. for a period of about 1 week (or about 2 weeks, or about 3 weeks, or about 4 weeks, or about 5 weeks, or about 6 weeks, or about 7 weeks, or about 8 weeks, or about 10 weeks, or about 3 months, or about 6 months or about 1 year). In some embodiments, at least 85% (or at least 90%, or at least 91%, or at least 92%, or at least 93%, or at least 94%, or at least 95%, or at least 96%, or at least 97%, or at least 98%, or at least 99% or more) of the antibody or fragment thereof is present in the composition in non-aggregate form after two weeks of storage at about 4° C. In some embodiments, at least 99% of the antibody is present in the composition in non-aggregate form after storage for two weeks at about 4° C. for two weeks and/or at least 95% of antibody present is in the compositions is in non-aggregate form after storage for two weeks at 40° C.

In various embodiments, less than 5% of the heterodimeric antibody or antibody fragment described herein in the composition is degraded. For instance, less than 4%, or less than 3%, or less than 2%, or less than 1% or less of the heterodimeric antibody or fragment thereof in the composition is degraded under conditions of interest. For example, optionally at least 85% (or at least 90%, or at least 91%, or at least 92%, or at least 93%, or at least 94%, or at least 95%, or at least 96%, or at least 97%, or at least 98%, or at least 99%) of the antibody or fragment is intact (i.e., not degraded) in a composition stored at about −30° C., about 4° C., about 20° C. or about 40° C. for a period of about 1 week (or about 2 weeks, or about 3 weeks, or about 4 weeks, or about 5 weeks, or about 6 weeks, or about 7 weeks, or about 8 weeks, or about 10 weeks, or about 3 months, or about 6 months or about 1 year). In some aspects, at least 85% (or at least 90%, or at least 91%, or at least 92%, or at least 93%, or at least 94%, or at least 95%, or at least 96%, or at least 97%, or at least 98%, or at least 99% or more) of the antibody or fragment thereof is intact (i.e., non-degraded) after storage in a composition at about 4° C. for a period of two weeks. In some embodiments, at least 99% of the antibody or fragment remains intact when stored in a composition at about 4° C. for two weeks and/or at least 95% remains intact when stored in a composition at about 40° C. for two weeks.

Functional or activity stability of the heterodimeric antibody (or antigen binding fragment there) in a composition also is contemplated herein. Assays for detecting and/or quantifying, e.g., antibody binding to a target, sclerostin neutralization, and DKK-1 neutralization are known in the art and are described herein in Examples 4-6. Optionally, the antibody or fragment thereof demonstrates about 50-100% activity under conditions of interest compared to the activity of the antibody or fragment thereof at the initial time point. For example, the antibody or fragment thereof retains a level of activity of between about 60-90% or 70-80% compared to the activity the initial time point. Accordingly, functional stability of the antibody or fragment thereof includes retention of activity of at least about 50%, 55%, 60%, 65%, 70%, 75%, 80%, 85%, 90%, 95% or 100% and can include activity measurements greater than 100% such as 105%, 110%, 115%, 120%, 125% or 150% or more compared to the activity at the initial time point.

Viscosity

In some embodiments, the viscosity of a composition comprising one or more of the heterodimeric antibodies described herein is determined. The term "viscosity" as used herein refers to "absolute viscosity." Absolute viscosity, sometimes called dynamic or simple viscosity, is the product of kinematic viscosity and fluid density (Absolute Viscosity=Kinematic Viscosity×Density). The dimension of kinematic viscosity is $L^2/T$ where L is a length and T is a time. Commonly, kinematic viscosity is expressed in centistokes (cSt). The SI unit of kinematic viscosity is $mm^2/s$, which is 1 cSt. Absolute viscosity is expressed in units of centipoise (cP). The SI unit of absolute viscosity is the millipascal-second (mPa-s), where 1 cP=1 mPa-s.

The viscosity of a composition can be measured hours (e.g., 1-23 hours), days (e.g., 1-10 days), weeks (e.g., 1-5 weeks), months (e.g., 1-12 months), or years (e.g., 1-2 years, 1-3 years) after the addition of the antibody to the composition. Viscosity measurements may be made at a storage or administration temperature, e.g. 2-8° C. or 25° C. (room temperature). In some embodiments, absolute viscosity of the liquid or reconstituted liquid composition at the storage and/or administration temperature is 15 cP or less, or 14, 13, 12, 11, 10, 9, 8, 7, 6, 5, or 4 cP or less. In some embodiments, absolute viscosity of the liquid or reconstituted liquid composition is 6 cP or less.

In some embodiments, the viscosity of the antibody composition is measured prior to and after the addition of heterodimeric antibody. Methods of measuring viscosity are well known in the art and include, for example, using a capillary viscometer, or a cone-plate rheometer. Any method may be used provided the same method is used to compare the test and reference formulations.

Kits

A pharmaceutical composition comprising one or more heterodimeric antibodies described herein may be placed within containers (e.g., vials or syringes), along with packaging material that provides instructions regarding the use of such pharmaceutical compositions. Generally, such instructions will include a tangible expression describing the heterodimeric antibody concentration, as well as within certain embodiments, relative amounts of excipient ingredients or diluents (e.g., water, saline or PBS) that may be necessary to reconstitute the pharmaceutical composition.

Additional Embodiments

Also contemplated are the following embodiments provided in the following numbered paragraphs:

1. An isolated antibody heavy chain variable region comprising an amino acid substitution within the framework region at AHo position 51 or 141, wherein the substitution introduces a positive- or negative-charged amino acid into the heavy chain variable region framework at said position.

2. The isolated antibody heavy chain variable region of paragraph 1, wherein AHo position 51 or AHo position 141 is substituted for a positive charged amino acid.

3. The isolated antibody heavy chain variable region of paragraph 2, further comprising a substitution at AHo position 46 for a positive charged amino acid.

4. The isolated antibody heavy chain variable region of paragraph 2 or paragraph 3, wherein AHo position 51 is substituted for a positive charged amino acid.

5. The isolated antibody heavy chain variable region of paragraph 1, 2, or 3, wherein AHo position 141 is substituted for a positive charge amino acid.

6. The isolated antibody heavy chain variable region of paragraph 3, wherein AHo position 46 and AHo position 141 are substituted for a positive charged amino acid.

7. The isolated antibody heavy chain of any of paragraphs 2-6, wherein the positive charged amino acid is lysine.

8. The isolated antibody heavy chain variable region of paragraph 1, wherein AHo position 51 or AHo position 141 is substituted for a negative charged amino acid.

9. The isolated antibody heavy chain variable region of paragraph 8, further comprising a substitution at AHo position 46 for a negative charged amino acid.

10. The isolated antibody heavy chain variable region of paragraph 8 or paragraph 9, wherein AHo position 51 is substituted for a negative charged amino acid.

11. The isolated antibody heavy chain variable region of paragraph 8, 9, or 10, wherein AHo position 141 is substituted for a negative charged amino acid.

12. The isolated antibody heavy chain variable region of paragraph 9, wherein AHo position 46 and AHo position 141 are substituted for a negative charged amino acid.

13. The isolated antibody heavy chain of any of paragraphs 8-12, wherein the negative charged amino acid is aspartic acid.

14. The isolated antibody heavy chain variable region of any of paragraphs 1-13, further comprising a heavy chain CH1 region.

15. The isolated antibody heavy chain variable region of paragraph 14, wherein the CH1 region comprises one or more amino acid additions, deletions, or substitutions.

16. The isolated antibody heavy chain variable region of paragraph 15, wherein an amino acid is substituted to introduce a positive- or negative-charged amino acid into the CH1 region.

17. The isolated antibody heavy chain variable region of paragraph 16, wherein the positive- or negative-charged amino acid is introduced at EU position S183.

18. The isolated antibody heavy chain variable region of paragraph 17, wherein EU position S183 is substituted for a positive-charged amino acid.

19. The isolated antibody heavy chain variable region of paragraph 18, wherein the substitution is S183K.

20. The isolated antibody heavy chain variable region of paragraph 17, wherein EU position S183 is substituted for a negative-charged amino acid.

21. The isolated antibody heavy chain variable region of paragraph 20, wherein the substitution is S183D.

22. An antibody heavy chain comprising the isolated antibody heavy chain variable region of any of paragraphs 1-21.

23. The antibody heavy chain of paragraph 22, wherein the heavy chain comprises a CH3 region comprising one or more amino acid substitutions disfavoring homodimerization.

24. The antibody heavy chain of paragraph 23, wherein a negative charged amino acid in the CH3 region is substituted with a positive charged amino acid.

25. The antibody heavy chain of paragraph 24, wherein the negative charged amino acid is EU position D399, E356, or E357.

26. The antibody heavy chain of paragraph 25, wherein the positive charged amino acid is lysine.

27. The antibody heavy chain of paragraph 26, wherein the CH3 region comprises D399K and E356K substitutions.

28. The antibody heavy chain of paragraph 23, wherein a positive charged amino acid in the CH3 region is substituted with a negative charged amino acid.

29. The antibody heavy chain of paragraph 28, wherein the positive charged amino acid is EU position K370, K392, or K409.

30. The antibody heavy chain of paragraph 29, wherein the negative charged amino acid is aspartic acid.

31. The antibody heavy chain of paragraph 30, wherein the CH3 region comprises K392D and K409D substitutions.

32. An antibody comprising the antibody heavy chain of any of paragraphs 24-27 and the antibody heavy chain of any of paragraphs 28-31.

33. The antibody heavy chain of any of paragraphs 22-31, wherein the heavy chain comprises a CH2 region comprising one or more amino acid substitutions altering an Fc effector function.

34. An antibody kappa light chain variable region comprising an amino acid substitution within the framework region at AHo position 51 or 141, wherein the substitution introduces a positive- or negative-charged amino acid into the kappa light chain variable region framework at said position.

35. The antibody kappa light chain variable region of paragraph 34, wherein AHo position 51 or AHo position 141 is substituted for a positive charged amino acid.

36. The antibody kappa light chain variable region of paragraph 35, further comprising a substitution at AHo position 46 for a positive charged amino acid.

37. The antibody kappa light chain variable region of paragraph 35 or 36, wherein AHo position 51 is substituted for a positive charged amino acid.

38. The antibody kappa light chain variable region of paragraph 35, 36, or 37, wherein AHo position 141 is substituted for a positive charged amino acid.

39. The antibody light chain of any of paragraphs 35-38, wherein the positive charged amino acid is lysine.

40. The antibody kappa light chain variable region of paragraph 34, wherein AHo position 51 or AHo position 141 is substituted for a negative charged amino acid.

41. The antibody kappa light chain variable region of paragraph 40, further comprising at substitution at AHo position 46 for a negative charged amino acid.

42. The antibody kappa light chain variable region of paragraph 40 or 41, wherein AHo position 51 is substituted for a negative charged amino acid.

43. The antibody kappa light chain variable region of paragraph 40, 41, or 42, wherein AHo position 141 is substituted for a negative charged amino acid.

44. The antibody light chain of any of paragraphs 40-43, wherein the positive charged amino acid is lysine.

45. The antibody kappa light chain variable region of any of paragraphs 34-44, further comprising a kappa light chain constant region.

46. The antibody kappa light chain variable region of paragraph 45, wherein the kappa light chain constant region comprises one or more amino acid additions, deletion, or substitutions.

47. The isolated antibody kappa chain variable region of paragraph 46, wherein an amino acid is substituted to introduce a positive- or negative-charged amino acid into the kappa light chain constant region.

48. The isolated antibody kappa chain variable region of paragraph 47, wherein the positive- or negative-charged amino acid is introduced at Eu position S176.

49. The isolated antibody kappa chain variable region of paragraph 48, wherein Eu position S176 is substituted for a positive charged amino acid.

50. The isolated antibody kappa chain variable region of paragraph 49, wherein the substitution is S176K.

51. The isolated antibody kappa chain variable region of paragraph 48, wherein Eu position S176 is substituted for a negative charged amino acid.

52. The isolated antibody kappa chain variable region of paragraph 51, wherein the substitution is S176D.

53. An antibody lambda light chain variable region comprising an amino acid substitution within the framework region at AHo position 51 or 141, wherein the substitution introduces a positive- or negative-charged amino acid into the lambda light chain variable region framework at said position.

54. The antibody lambda light chain variable region of paragraph 53, further comprising a lambda light chain constant region.

55. The antibody lambda light chain variable region of paragraph 54, wherein the lambda light chain constant region comprises one or more amino acid additions, deletion, or substitutions.

56. The isolated antibody lambda chain variable region of paragraph 55, wherein an amino acid is substituted to introduce a positive- or negative-charged amino acid into the lambda light chain constant region.

57. The isolated antibody lambda chain variable region of paragraph 56, wherein the positive- or negative-charged amino acid is introduced at Kabat position S176.

58. The isolated antibody lambda chain variable region of paragraph 57, wherein S176 is substituted for a positive charged amino acid.

59. The isolated antibody lambda chain variable region of paragraph 58, wherein the substitution is S176K.

60. The isolated antibody lambda chain variable region of paragraph 57, wherein S176 is substituted for a negative charged amino acid.

61. The isolated antibody lambda chain variable region of paragraph 60, wherein the substitution is S176D or S176E.

62. An isolated nucleic acid encoding the antibody heavy chain variable region of any of paragraphs 1-21, the antibody heavy chain of any of paragraphs 22-31, the antibody kappa light chain variable region of any of paragraphs 34-52, or the antibody light chain variable region of any of paragraphs 53-61.

63. An expression vector comprising the isolated nucleic acid of paragraph 62 operably linked to a promoter.

64. A recombinant host cell comprising the isolated nucleic acid of paragraph 62.

65. A recombinant host cell comprising the expression vector of paragraph 63.

66. An antigen binding protein comprising the isolated heavy chain variable region on any of paragraphs 1-21 and the isolated light chain variable region of any of paragraphs 22-31 or 34-52.

67. The antigen binding protein of paragraph 66, wherein the antigen binding protein is an antibody comprising two heavy chains and two light chains.

68. The antigen binding protein of paragraph 67, wherein the antibody is a bi-specific antibody.

69. A pharmaceutical composition comprising the antigen binding protein of any of paragraphs 66-68.

EXAMPLES

Example 1

DKK1 Expression is Induced by Sclerostin Antibody Treatment

The effect of anti-sclerostin antibody treatment on DKK1 expression in bones of different animal models was evaluated. Unexpectedly, in all of the animal models, a significant increase in DKK1 expression was detected in whole bone extracts of animals treated with an anti-sclerostin antibody. This increased expression was observed in bones extracted from normal animals, animal models of postmenopausal osteoporosis, and animal models of fracture healing. The observed increase in DKK1 expression upon anti-sclerostin antibody treatment occurred in all three species tested (mice, rats and primates).

Figure 8:
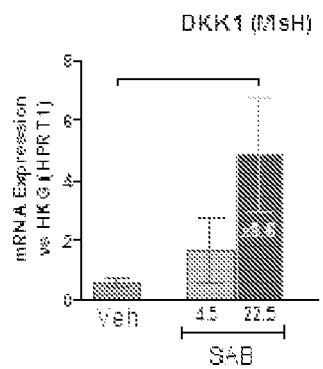
FIG. 8 is a graph correlating DKK1 mRNA expression (y-axis) with dose (mg/kg) of Ab-5 administered to cynomologous monkey (x-axis). The illustrated data demonstrates that sclerostin antibody treatment induces DKK1 mRNA expression in the humerus midshaft and lumbar vertebrae of the cynomologous monkey.

Exemplary study details are as follows: 13-year-old normal, male cynomolgus monkeys were treated every 2 weeks with either 4.5 or 22.5 mg/kg of Ab-5 (anti-sclerostin antibody (SAB)) for a total of 8 weeks. At the end of the study the animals were humanely euthanized and tissues, including bone, were harvested. RNA was isolated from the bone and DKK1 RNA expression was determined using the QuantiGene branched DNA (bDNA) assay (Affymetrix), following the manufacturer's instructions, and probe sets specific to cynomolgus DKK1 mRNA and housekeeping genes. The data illustrated in FIG. 8 demonstrate an increase in DKK1 expression in the humerus midshaft at the lower dose (4.5 mg/kg) and a significant induction in DKK1 mRNA at the highest dose (22.5 mg/kg). Increased DKK1 expression was also observed in the lumbar vertebrae. The data are presented as normalized expression compared to the housekeeping (HKG) gene HPRT (+/−standard deviation). The bracket above the graph of FIG. 8 represents $p<0.05$ (ANOVA).

The data presented herein demonstrates that anti-sclerostin antibody treatment induced DKK1 expression independent of the incidence of disease and is likely applicable to all species including humans. The induction of DKK1 may limit the activity of the anti-sclerostin antibody, and suggests that a therapeutic that inhibits both sclerostin and DKK1 demonstrates better activity. Furthermore, increased DKK1 expression may serve as a biomarker for sclerostin antibody treatment.

Example 2

Generation of Linkerbodies

The following Example describes the generation of heterodimeric antibodies (with an IgG1 backbone) wherein the light and heavy chains of (a) an anti-sclerostin antibody and (b) an anti-DKK1 antibody are covalently linked using a G4S linker to form a single polypeptide chain that binds sclerostin and a single polypeptide chain that binds DKK1 ("linkerbodies"). The polypeptide chains or half antibodies against the DKK1 and sclerostin targets are then assembled as a bispecific antibody through charge pair substitutions at the CH3 domain (i.e., one heavy chain contained K392D and K409D substitutions and the other contained E356K and D399K substitutions). The charge pair substitutions employ the electrostatic steering mechanism described herein, whereby heterodimer formation (DKK1 Ab—sclerostin Ab) is encouraged by attraction between negatively- and positively-charged residues in the CH3 regions and homodimers (two DKK1 Ab arms or two aclerostin Ab arms) are discouraged due to repulsion between amino acids having the same charge at corresponding regions of the CH3-CH3 interface. Charge pair substitutions were also introduced at the CH1-CL domain interface in order to reduce the level of aggregation (S183K/E in the heavy chain and S176E/K in the light chain). Further, some of the linkerbodies also had engineered inter-domain disulfide bonds at the VL-VH interface for further stabilization of heavy-light chain interactions. This was achieved by substituting G44 (Kabat) in the heavy chain and G100 (Kabat) in the light chain to cysteine residues.

The methods described above resulted in a high level of aggregation as determined by Size Exclusion Chromatography (SEC). In order to reduce the level of aggregation, a G4S linker was either added or replaced between the light and heavy chains with a charge pair substitution in the heavy and light chain constant regions (CH1-CL1). It was contemplated that the aggregation level would be reduced as a result of adding the charge pair substitution to the linkerbody constructs.

The linkerbody design in combination with charge pair substitutions in the CH1-CL interface still resulted in unwanted aggregation issues in several constructs.

Example 3

Generation of Heterodimeric Antibody without Linkers

The following Example describes the generation of a heterodimeric antibody having no linkers but, instead, comprising charge pair substitution in both the CH/CL interface and the CH3/CH3 interface of the parent antibodies. The resulting heterodimeric antibody comprising charged substitutions in the CH/CL and CH3/CH3 interfaces is referenced herein as heterodimeric antibody version 1 or heteroIg-v1.

Briefly, the following substitutions were introduced into DKK1 antibody 6.37.5: K392D (EU) and K409D (EU) substitutions in the CH3 domain, S183K (EU) substitution in the CH1 domain, and S176E (EU) substitution in the CL domain. The following substitutions were introduced into sclerostin antibody 27H6: E356K (EU) and D399K (EU) substitutions in the CH3 domain, S183E (EU) substitution in the CH1 domain, and S176K (EU) substitution in the CL domain. IgG1 scaffold was used in the heterodimeric version 1design.

Various input DNA ratios for the two different antibodies were used to maximize the IgG production and minimize the aggregation level (High Molecular Weight species). Using equal amount of DNA for both antibodies led to minimal aggregation level.

In order to assess the hetero Ig bispecific antibody formation, the material was purified and subjected to mass spectrometry analysis. NR mass analysis confirmed that the antibody product had two different light chains and two different heavy chains. To confirm the specific light-heavy chain pairing, the Fab fragments were generated through proteolysis (Pierce Fab Micro Preparation Kit). The mass analysis showed only two species, one corresponding to the DKK1 antibody heavy and light chain pairing and the other corresponding to that of a sclerostin antibody. The mass analysis confirmed the presence of heterodimeric antibodies having the correct pairing of light and heavy chains in both the arms of sclerostin/DKK1 heterodimeric antibody.

The mass analysis indicated the presence of a single species of antibody in the purified sample, with the observed mass matching the calculated mass of the heterodimeric antibody. The resulting heterodimeric antibody had two light chains and two heavy chains, with the heavy chain of the anti-sclerostin portion of the heterodimeric antibody having a S183E (EU) substitution in the CH1 domain and the light chain of the anti-sclerostin portion having a S176K (EU) substitution in the CL domain. The heavy chain of the anti-DKK1 portion of the heterodimeric antibody had a S183K (EU) substitution the CH1 domain and the light chain of the DKK1 portion had a S176E (EU) substitution in the CL domain. The CH3 domain of the anti-sclerostin portion of the heterodimeric antibody had E356K (EU) and D399K (EU) substitutions and the CH3 domain of the anti-DKK1 portion had substitutions at K392D (EU) and K409D (EU).

The ability of the generated heterodimeric antibodies to activate canonical Wnt signaling in the presence of sclerostin and/or DKK1 was evaluated in an independent osteoblast Wnt activation assay where cells are induced to differentiate and secrete factors that activate Wnt signaling in an autocrine fashion. In the assay, MC3T3-E1 cells were transfected with a Super-TOPFlash reporter construct, and stable cell lines were selected and evaluated. MC3T3E1/TetONWnt1/Luciferase is a mouse osteblast cell line engineered with a T-Cell factor response luciferase construct, Tet Repressor construct and a doxycycline inducible Wnt-1 construct using lentiviral transduction. In the presence of doxycycline, the MC3T3E1/TetONWnt1/Luc cells express Wnt-1 and induce signal transduction via the binding of Wnt-1 to cell surface LRP5/6 and Frizzled receptors resulting in the expression of luciferase. When MC3T3E1/TetON-Wnt1/Luc#5 cell are incubated in the presence of sclerostin and/or DKK1 Wnt signaling is inhibited by these proteins via the LrpS/6 beta propeller 1 motif. The bioassay measures the dose dependent stimulatory effect in the cell-based reporter assay of the heterodimeric antibody and parental antibodies treated with a fixed concentration of sclerostin and/or DKK1.

Clone C10 demonstrated decreased reporter activity following incubation with either purified sclerostin or DKK1 proteins due to inhibition of Wnt pathway activation. Cells were cultured in Expansion Medium (Alpha-MEM medium containing 10% FBS, 1×Pen-Strep-Glu and 1.0 ug/ml of puromycin). When the cells reached 80% confluence, the medium was switched to Differentiation Medium "DM" (Expansion Medium, 50 ug/ml ascorbic acid and 10 mM beta-glycerophosphate) for 4 days. Following differentiation, this cell line produced an endogenous protein(s) that triggers canonical Wnt activation in an autocrine manner. Media was aspirated and 100 μls of fresh DM containing various concentrations of monospecific or heterodimeric antibodies (pre-incubated for 4 hours with DKK1 and/or sclerostin for 45-60 min at 37° C.) was added to the wells for 24 hours. Luciferase activity was measured following manufacturer's instructions (Promega's Luciferase Assay System, Cat No: E4530). Various rat and human bispecific antibodies tested were capable of dose-dependently activating the osteoblast canonical Wnt pathway in the presence of both sclerostin and DKK1, further demonstrating that the antibodies can simultaneously neutralize the Wnt inhibitory function of both soluble proteins.

Results indicated that both the heterodimeric antibody produced according to the methods described in this Example and the linkerbody (which was used as a positive control) had very similar activity, further confirming correct pairing of the light and heavy chains.

Example 4

Generation of Heterodimeric Antibodies Having Substitutions in CH3 Domain(s), CH/CL Domain(s) and VH/VL Domain(s)

The following Example describes the generation of heterodimeric antibodies having one or more substitutions in each of the CH3, CH/CL and VH/VL domains to further favor correct pairing of the light and heavy chains. The heterodimeric antibodies are based on either Ab-5 and Ab-23 for the sclerostin portion and antibodies 6.147 and 6.37.5 for the DKK1 portion. An IgG2 class constant domain was used here in order to prevent ADCC and discourage effector functions. The resulting heterodimeric antibody comprising charged substitutions in the VH/VL, CH/CL and CH3/CH3 interfaces is referenced herein as heterodimeric antibody version 2 or heteroIg-v2.

When co-expressing two different antibodies inside one cell, four different chains (HC1, LC1, HC2, LC2) are transcribed and translated. HCs can form either homodimer (HC1-HC1) or heterodimer (HC1-HC2); LCs can randomly assemble with two different HCs. In all, ten different combinations can occur [Paul Carter *J Immunological Methods* 248 (2001) 7-15]. Undesired heavy chain homodimers can be minimized by engineering the $C_H3$ region to only form a heterodimer. This Example demonstrates that undesirable LC/HC pairings can be eliminated by engineering the interface of the LC/HC to enforce the correct pairing of LCs with their cognate HCs. An electrostatic-steering mechanism was applied to direct the pairing and assembly of LC/HC; opposite polarity attracts desired complex subunits while the same polarity of homodimer subunits is repulsive.

Several criteria were applied when selecting the pairs of residues along the heavy chain and light chain interface for replacement by charged residues with opposing polarity, e.g., Asp or Lys, to control the correct pairing of LC with its cognate HC: 1) All positions are located in close proximity within both the VL/VH and CL/$C_H1$ interfaces; 2) All positions are buried and are well conserved among most, if not all, of different antibody families; 3) All positions have minimal impact on expression and antigen binding; and 4) The introduction of charged residues does not interfere with the binding of chaperone BiP to the $C_H1$ region in the process of antibody folding and assembly.

The selected residues at the VL/VH and $C_K/C_H1$ interfaces for engineering are listed in Table 2. In the variable regions, predominant AHo position 46 (Q39 Kabat), AHo position 51 (Kabat G44), and AHo position 141 (Kabat Q105) in VH are in close proximity to AHo position 46 (Kabat Q38), AHo position 141 (Kabat Q100), and AHo position 51 (Kabat A43) in VL, respectively. In the constant regions, A141 (EU), P171 (EU), and S183 (EU) in $C_H1$ region contact residues F116 (EU), S162 (EU), and S176 (EU) in Ck respectively, but K147 (EU) in $C_H1$ can interact with either Q124 (EU), 5131 (EU), or T180 (EU) in Ck region.

TABLE 2

The amino acid residues located at the VH/VL and CH1/Cκ interfaces were selected for the introduction of charge pair residues.

| VH | | | | | | contact | VL | | | | | |
|---|---|---|---|---|---|---|---|---|---|---|---|---|
| IMGT # | Kabat # | Eu # | AHo # | FW | Residue | | IMGT # | Kabat # | Eu # | AHo # | FW | Residue |
| 44 | 39 | 39 | 46 | 2 | $Q_{I R/T}$ | ↔ | 44 | 38 | 38 | 46 | 2 | $Q_{I G/H/L}$ |
| 49 | 44 | 44 | 51 | 2 | $G_{I R/A}$ | ↔ | * | 100 | 100 | 141 | 4 | $Q_{I G/P}$ |
| * | 105 | 109 | 141 | 4 | $Q_{I K/R/S}$ | ↔ | 49 | 43 | 43 | 51 | 2 | $A_{I G/S/P}$ |

| $C_H 1$ | | | | | | contact | Cκ | | | | | |
|---|---|---|---|---|---|---|---|---|---|---|---|---|
| IMGT # | Kabat # | Eu # | AHo # | Ref # | Residue | | IMGT # | Kabat # | Eu # | AHo # | Ref # | Residue |
| 20 | 139 | 141 | * | 176 | A | ↔ | 5 | 116 | 116 | * | 158 | F |
| 82 | 175 | 171 | * | 212 | P | ↔ | 81 | 162 | 162 | * | 211 | s |
| 86 | 188 | 183 | * | 230 | s | ↔ | 86 | 176 | 176 | * | 230 | s |
| 26 | 145 | 147 | * | 182 | K | ↔ | 13 | 124 | 124 | * | 166 | Q |
| 26 | 145 | 147 | * | 182 | K | ↔ | 20 | 131 | 131 | * | 176 | s |
| 26 | 145 | 147 | * | 182 | K | ↔ | 90 | 180 | 180 | * | 234 | T |

FW: Framework.
Germline residues of VH and VL are numbered by different numbering systems, the bolded residues are the dominant ones. The contact residues in VH/VL of most of antibodies are arrayed in the same row. Residues of human IgG1CH1 domain contacting the residues in Cκ region are also bolded and laid in the same row.

Wnt1-driven osteoblast reporter analysis of the heterodimeric antibodies showed robust activation of canonical Wnt signaling in the presence of both DKK1 and Sclerostin whereas control DKK1 antibodies (6.37.5, 6.147) and control Sclerostin antibody (Ab-23) only partially reversed inhibition.

The engineered heterodimeric antibodies were capable of neutralizing DKK1 and blocking recombinant Wnt3a induced TCF/LEF luciferase activity as seen in an independent cell based assay. In this assay, Wnt signaling was induced in an MC3T3 E1/STF-luciferase stable cell line with 100 ng/ml of recombinant Wnt3a protein (R&D Systems) for 30 minutes at 4° C. Cells were subsequently treated with human DKK1 protein at 0.15 ug/ml that was pre-mixed with control PBS or a two-fold serial dilution of the heterodimeric antibodies starting at 426.7 nM. The luciferase signal was determined after 24 hours as described above and the data were plotted by using PRISM software. Results indicated that the heterodimeric antibodies with variable regions targeting both the loop 2 region of sclerostin (i.e., amino acids 86-111 of SEQ ID NO: 1) and DKK1 were capable of neutralizing Sclerostin and DKK1 and increased reporter activity driven by Wnt3a.

Example 5

Functional Analysis of Parental and Heterodimeric Antibodies

Functional analysis of anti-Sclerostin parental antibodies directed against the loop 2 region of sclerostin (Ab23, Ab5, 20C3) and against non-loop 2 epitopes (27H6, Ab13, Ab-D, Ab-3) revealed a unique mechanism of action for each group of antibodies. A competition alpha screen binding assay was conducted to measure the effects of increasing concentrations of parental sclerostin antibodies on the interaction between his-tagged LRP6 and biotin-labeled human sclerostin. This analysis revealed that where anti-sclerostin antibodies that bound the loop 2 region of sclerostin potently inhibited the interaction between sclerostin and LRP6, antibodies directed against non-loop2 regions of sclerostin increased the interaction between these proteins. Furthermore, the engineered heterodimeric antibodies showed a similar phenomenon where heterodimeric antibodies directed against non-loop 2 sclerostin epitopes (i.e., 27H6-6.37.5, 6.147-27H6) promoted increased binding of LRP6 to sclerostin unlike the heterodimeric antibodies directed again the loop 2 region of sclerostin. All heterodimeric antibodies were found to compete with human DKK1 for binding to LRP6.

To understand the impact of this phenomenon on canonical Wnt pathway activation, parental antibodies and heterodimeric antibodies were studied in TCF-reporter cell based assays using osteoblasts and 293 cells. Cells were stimulated with either Wnt1 which binds to LRP6 beta propeller 1 motif or Wnt3a which binds to the LRP6 beta propeller 3 motif. Canonical Wnt pathway activation was measured by increased luciferase activity. In the assays, sclerostin and/or DKK1 were added to inhibit reporter activity and the neutralizing activity of different anti-sclerostin or anti-DKK1 antibodies was studied. Whereas sclerostin inhibited Wnt3a-driven activation of the TCF reporter, an anti-sclerostin non-loop 2 region binding antibody (27H6) but not control loop 2 binding antibodies (Ab5 and Ab23) potentiated Wnt3a signaling. Similar Wnt3a potentiation results were obtained with heterodimeric antibodies containing anti-sclerostin variable regions against non-loop 2 regions of sclerostin. In contrast, Wnt1 activity was restored by sclerostin inhibition with either antibody as shown by increased luciferase activity that did not exceed that of untreated controls. These effects were dependent on the presence of sclerostin since no potentiation was observed in the absence of sclerostin with the heterodimeric antibodies directed to the non-loop 2 regions of sclerostin. A similar analysis of other heterodimeric antibodies showed that heterodimeric antibodies comprising an anti-sclerostin portion that bound loop 2 of sclerostin failed to potentiate Wnt3a, whereas heterodimeric antibodies containing variable regions that bound non-loop2 regions of sclerostin did potentiate Wnt3a signaling. In addition, heterodimeric antibodies comprising variable regions that bound non-loop 2 regions of sclerostin potentiated Wnt3a signaling in the presence of DKK1, whereas monospecific non-loop 2 heterodimeric antibody potentiation is inhibited in the presence of DKK1. All canonical Wnt activation was inhibited in the presence of DKK1 alone consistent with the recent reports showing that the C-terminal region of DKK1 binds to the beta propeller 3 motif of LRP6 and blocks the interaction of Wnt3a class proteins with this region (Cheng et al, Nature Structural Mol Biol, 2011; Anh Dev Cell 2011). These data suggest that antibody-ligand complexes bound to the beta propeller domain 1 via sclerostin may impact the conformation of the receptor in such a manner as to increase Wnt3a/beta propeller 3 activity. A similar Wnt3a-dependent potentiation phenomenon by anti-LRP6 beta propeller 1-binding antibodies has previously been reported where these antibodies increased mitogenicity in cancer cell lines and growth of tumor xenografts (Ettenberg et al, PNAS 2010).

Wnt3a-potentiation by non-loop 2 binding anti-sclerostin antibodies was also observed in non-osteoblastic cells. This result raised the possibility that sclerostin/non-loop 2 binding antibody complexes could activate Wnt signaling in any cell type expressing LRP6 provided Wnt3 class proteins or beta propeller 3 binding proteins are present and DKK1 is absent. In the case of a heterodimeric antibody, potentiation may occur in the presence of DKK1. Based on these observations and to mitigate risk of mitogenicity in non-osteoblastic cells, new heterodimeric antibodies were engineered with anti-sclerostin variable regions directed against the loop 2 region which were shown to robustly increase reporter activity in the Wnt1-osteoblast TCF reporter assay.

In addition, parental anti-sclerostin antibodies that bind non-loop 2 regions of sclerostin do not disrupt the interaction of sclerostin with its cognate LRP receptors and preserve either LRP6 interactions or LRP4 interactions. Although parental sclerostin antibodies against the loop 2 region of sclerostin and heterodimeric antibodies inhibited the interaction between LRP6 and sclerostin, they failed to inhibit the interaction between sclerostin and LRP4 in co-immunoprecipitation experiments. In contrast, parental antibodies or heterodimeric antibodies containing anti-non-loop 2 variable domains all decreased binding between LRP4 and Sclerostin (19D11, 27H6, L8 and N22). New heterodimeric antibodies were engineered in an IgG2 backbone.

Example 6

Heterodimeric Antibodies Demonstrated Activity In Vivo

The following Example demonstrates that heterodimeric antibodies generated according to the methods described in Examples 3 and 4 increased bone mineral density in an animal model of low bone mineral density.

Male 10 week old B6D2F1 mice were used in this study. At the beginning of the study, animals were divided into 5 groups (n=9/group), balanced by both body weight and bone mineral density (BMD) at the femur-tibia region by in vivo DXA. Mice were subcutaneously injected with either vehicle (proline) or sclerostin-Ab (Scl-Ab), or DKK1-Ab or combination of Scl-Ab and DKK1-Ab (combination) or heterodimeric antibody (hetero Ig) twice per week for 3 weeks. The antibodies were dosed at 12.5 mg/ml. Animals were scanned weekly by in vivo DXA to monitor the bone anabolic activity of the drug treatments at lumbar vertebral and femur-tibia regions. The mice were subsequently euthanized at the end of study. Femurs were collected for ex vivo densitometry by μCT and bone strength analysis.

FIG. 1 illustrates the in vivo study design for the following heterodimeric antibodies: (1) Ab23-Ab6.147 v2, (2) Ab5-Ab6.37.5 v1, and (3) Ab5-Ab6.147 v1. Ab-5 is used as mono-therapy control and DVD Ig 6.147-Ab23 (described in International Publication No. WO 2012/118903) is used as bispecific antibody control in this study. The DVD Ig was dosed slightly higher (17 mg/kg) due to the higher molecular weight than the monotherapy control and heterodimeric antibodies. It must be noted here that the heterodimeric antibodiy format is monovalent against each target, whereas the DVD is bivalent against each target. Therefore, although in terms of molarity, the dosing level makes DVD and heterodimeric antibody (hetero Ig) equivalent, they are different in terms of number of binding sites (paratopes).

Figure 2:
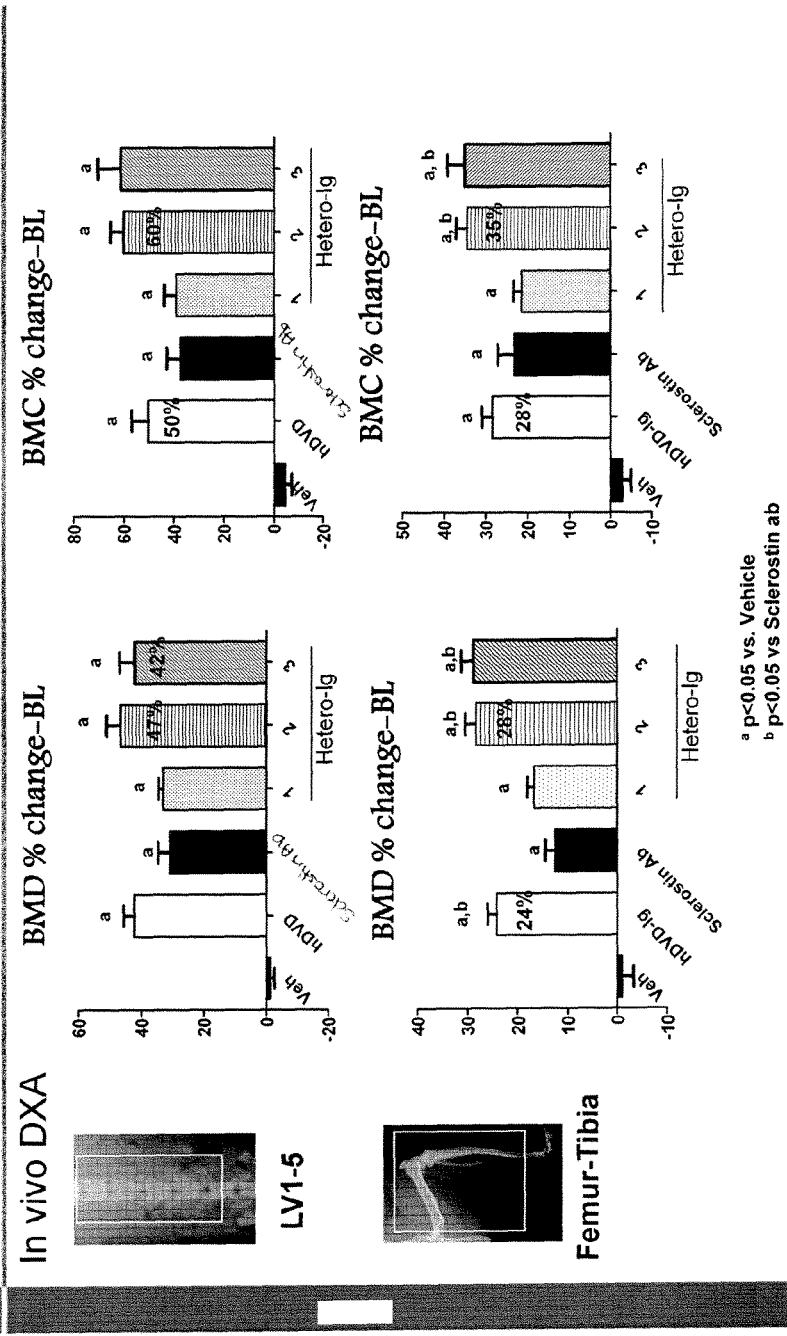
FIG. 2 compares percentage of bone mass density (BMD) increase in lumbar vertebrae and leg in mice between monospecific Ig (Ab5), bispecific DVD (6.147-Ab23) and heterodimeric antibodies (1, 2, & 3) at week 3.
Figure 3B:
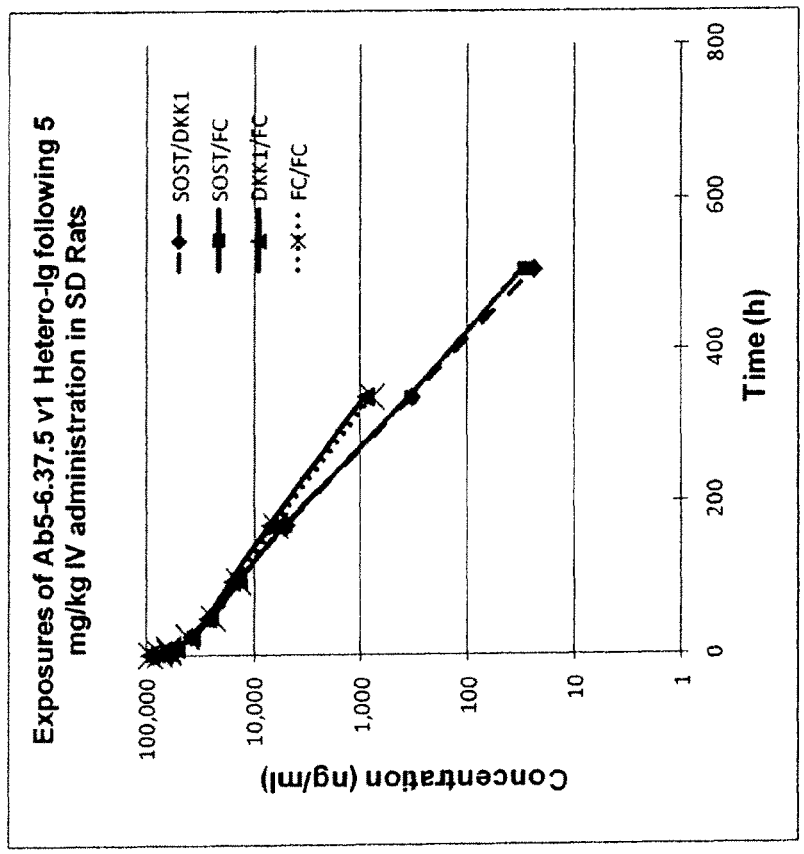
FIG. 3 shows the pharmacokinetic (PK) profiles of four sclerostin-DKK1 heterodimeric antibodies (i.e., Ab23-6.37.5 v1, Ab5-6.37.5 v1, Ab5-6.147 v2 and Ab23-6.147 v2).
Figure 3A:
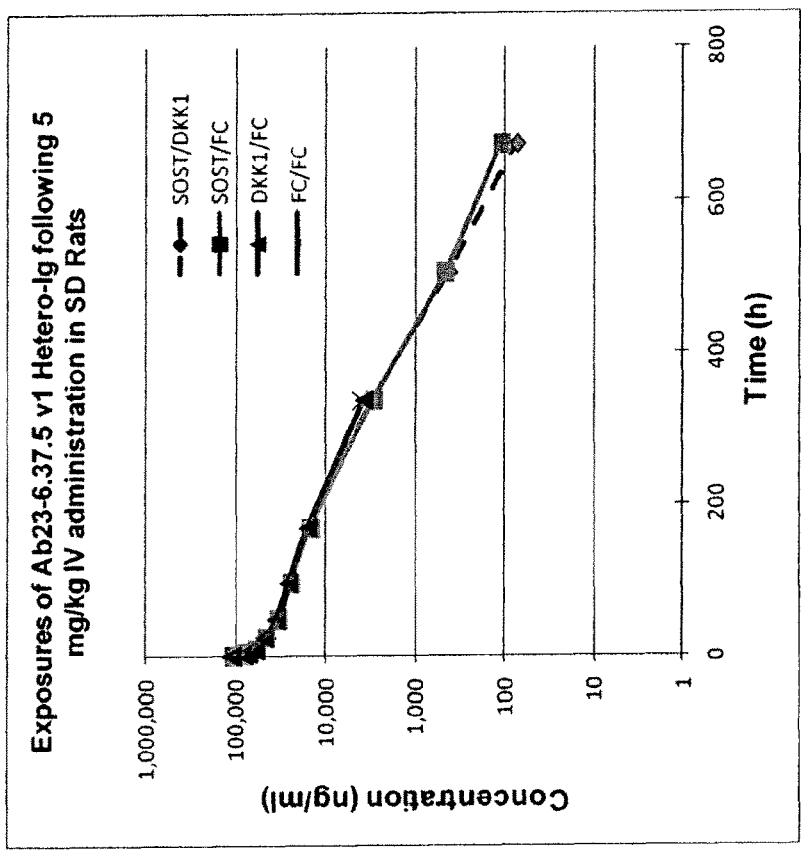
Figure 3D:
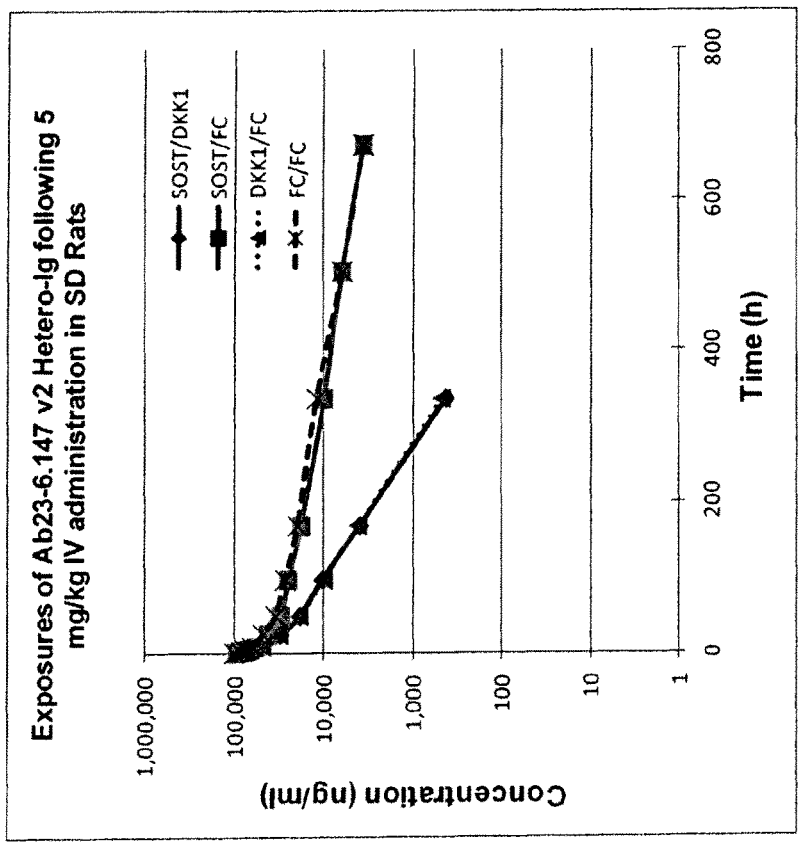
Figure 3C:
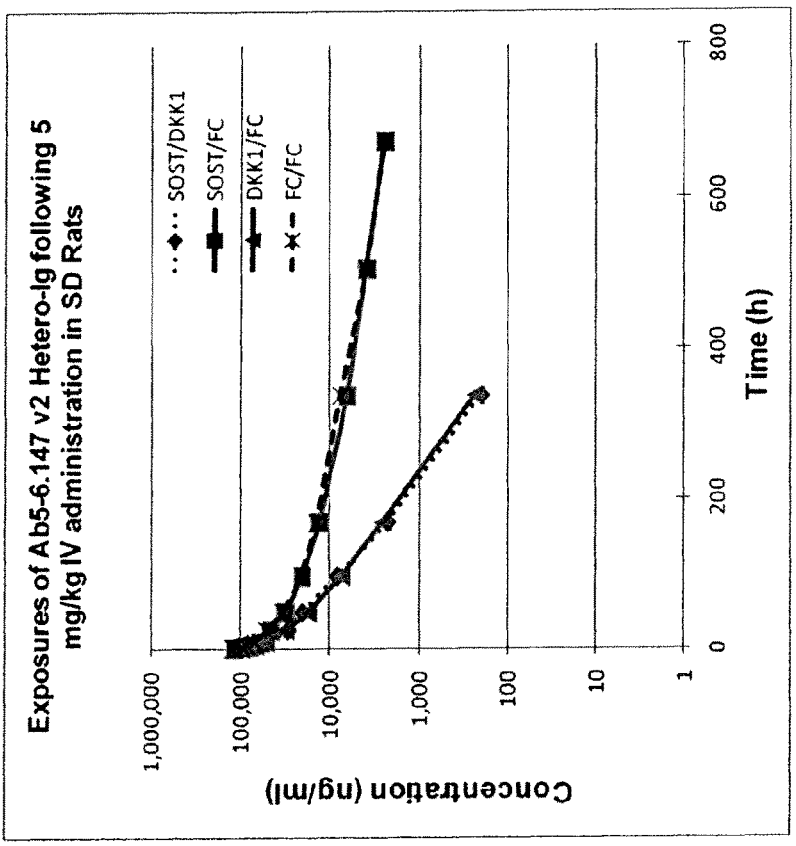

FIG. 2 compares percentage of bone mass density (BMD) increase in lumbar vertebrae and leg in mice between monospecific Ig (Ab5), bispecific DVD (6.147-Ab23) and heterodimeric antibodies 1, 2, & 3 described above at week 3.

The data shown in FIG. 2 clearly demonstrate heterodimeric antibodies Ab5-6.37.5 v1 (heterodimeric antibody 2—"heteroIg2") and 785-6.147 v1 (heterodimeric antibody 3—"heteroIg3") increased the bone mass density. However, the heterodimeric antibody Ab23-6.147 v2 (heterodimeric antibody 1—"heteroIg1") which has extra charge pair substitution in the variable domain interface (VH/VL) did not increase the BMD. It was expected that adding additional charge pair substitution in the variable domain would help achieve specific pairing of the light and heavy chains (e.g., Ab5 light pairing with Ab5 heavy chain). But, it appears that in this case the additional charge pair substitution in the variable domain led to poor stability of the heterodimeric antibody. The PK study that followed this PD study indeed demonstrated DKK1 arm of the heterodimeric antibody Ab23-6.147 having poor in vivo stability.

Example 7

Pharmacokinetic Data

Four different pharmacokinetic assays (i.e., sclerostin/DKK1 Assay; sclerostin/Fc Assay; DKK1/sclerostin Assay; and FC/FC bridging ELISA Assay) were performed in order to capture and detect heterodimeric antibodies in serum samples.

Sclerostin/DKK1 Assay: Briefly, half area plates were coated with 1 μg/ml of human sclerostin in 1×PBS and incubated overnight at 4° C. The plates were blocked for at least 1 h by I-Block buffer. Standards (Stds)) and quality control samples (QCs) were prepared in Rat serum samples. Standards, QCs, and serum samples were diluted 1:30 in buffer (1×PBS, 1M NaCl, 0.5% tween 20, and 10 mg/ml BSA). The diluted Stds, QCs, and samples were then loaded into ELISA plate and incubated for 90 min. Then the ELISA plate was washed and 200 ng/ml of biotinylated human DKK1 in the buffer was added and incubated for 90 minutes. The plate was washed and 200 ng/ml Streptavidin-HRP conjugated added and incubated for 30 minutes. After washing the plate, TMB substrate was added. The reaction was stopped after 15 minutes by addition of 1 M of sulfuric acid. The plate was then read by a SpectraMax plate reader.

Sclerostin/FC Assay: Half area plates were coated with 1 μg/ml of human sclerostin in 1×PBS and incubated overnight at 4° C. The plates were blocked for at least 1 hour by I-Block buffer. Standards (Stds)) and quality control samples (QCs) were prepared in Rat serum samples. Standards, QCs, and serum samples were diluted 1:30 in buffer (1×PBS, 1M NaCl, 0.5% tween 20, and 10 mg/ml BSA). The diluted Stds, QCs, and samples were then loaded into ELISA plate and incubated for 90 minutes. Then the ELISA plate was washed and 10 ng/ml of HRP conjugated anti-human Fc antibody, Mab 1.35.1 was added and incubated for 90 minutes. After washing the plate, TMB substrate was added. The reaction was stopped after 15 minutes by addition of 1 M of sulfuric acid. The plate was then read by a SpectraMax plate reader.

DKK1/FC Assay: Half area plates were coated with 1 μg/ml of human DKK1 in 1×PBS and incubated overnight at 4° C. The plates were blocked for at least 1 hour by I-Block buffer. Standards (Stds)) and quality control samples (QCs) were prepared in Rat serum samples. Standards, QCs, and serum samples were diluted 1:30 in buffer (1×PBS, 1M NaCl, 0.5% tween 20, and 10 mg/ml BSA). The diluted Stds, QCs, and samples were then loaded into ELISA plate and incubated for 90 min. Then the ELISA plate was washed and 10 ng/ml of HRP conjugated anti-hu Fc antibody, Mab 1.35.1 was added and incubated for 90 minutes. After washing the plate, TMB substrate was added. The reaction was stopped after 15 minutes by addition of 1 M of sulfuric acid. The plate was then read by a SpectraMax plate reader.

FC/FC bridging ELISA Assay: Briefly, half area plates were coated with 0.2 μg/ml of anti-human Fc antibody, Mab 1.35.1 in 1×PBS and incubated overnight at 4° C. The plates were blocked for at least 1 hour by I-Block buffer. Standards (Stds) and quality control samples (QCs) were prepared in rat serum samples. Standards, QCs, and serum samples were diluted 1:30 in buffer (1×PBS, 1M NaCl, 0.5% tween 20, and 10 mg/ml BSA). Then, the diluted Stds, QCs, and samples were loaded into ELISA plate and incubated for 90 min. Then the ELISA plate was washed and 50 ng/ml of HRP conjugated anti-human Fc antibody, Mab 1.35.1 was added and incubated for 30 min. After washing the plate, TMB substrate was added. The reaction was stopped after 10 minutes by addition of 1 M of sulfuric acid. The plate was then read by a SpectraMax plate reader.

FIG. 3 shows the pharmacokinetic (PK) profiles of the four sclerostin-DKK1 heterodimeric antibodies tested (i.e., Ab23-6.37.5 v1, Ab5-6.37.5 v1, Ab5-6.147 v2 and Ab23-6.147 v2). Results indicated that heterodimeric antibodies comprising a charged amino acid substitutions in the VH/VL domains negatively impacted the stability as the PK profiles based on the sclerostin/DKK1 & DKK1/Fc assays deviated from that of the sclerostin/Fc & Fc/Fc assays.

Example 8

Controlling the Correct Pairing of Light Chain with its Cognate Heavy Chain During the Production of Heterodimeric Antibodies by Electrostatic Steering Mechanism When co-expressing two different antibodies inside one cell, four different chains (HC1, LC, HC2, LC2) are transcribed and translated. HCs can form either homodimer or heterodimer; LCs can randomly assemble with two different HCs. Ten different combinations can occur [Paul Carter J Immunological Methods 248 (2001) 7-15]. The undesired side products derived from heavy chain homodimer can be minimized by engineering the CH3 region to only form a heterodimer. This Example demonstrates that undesirable LC/HC pairings can be eliminated by engineering the interface of the LC/HC to enforce the correct pairing of LCs with their cognate HCs. An electrostatic-steering mechanism was applied to direct the pairing and assembly of LC/HC, as the opposite polarity is attractive while the same polarity is repulsive.

Several criteria were applied when selecting the pairs of residues along the heavy chain and light chain interface that were replaced by charged residues with opposing polarity, e.g., Asp or Lys, to control the correct pairing of LC with its cognate HC: 1) All positions are located in close proximity within both the VL/VH and CL/CH1 interfaces; 2) All positions are buried and are well conserved among most, if not all, of different antibody families; 3) All positions have minimal impact on expression and antigen binding; and 4) The introduction of charged residues does not interfere with the binding of chaperone BiP to the CH1 region in the process of antibody folding and assembly.

The selected residues at the VL/VH and Cκ/CH1 interfaces for engineering Her2/EGFR heterodimeric antibodies are listed in Table 2. In the variable regions, predominant Q39 (Kabat numbering; AHo position 46), G44 (AHo position 51), and Q105 (AHo position 141) in VH are in close proximity to Q38 (Kabat numbering; AHo position 46), Q100 (AHo position 141), and A43 (AHo position 51) in VL, respectively. In the constant regions, A141 (Eu numbering), P171, and S183 in CH1 region contact residues F116 (Eu numbering), S162, and S176 in Ck respectively, but K147 (Eu numbering) in CH1 can interact with either Q124, S131, or T180 (Eu numbering) in Ck region.

A proof of concept heterodimeric IgG was constructed using v-genes from an anti-EGFR antibody and an anti-HER2 antibody. FIG. 4 shows different configurations for making heterodimeric antibody variants. One Fc chain has ADCC-enhancement substitutions S298T+A330M+K334V in CH2 domain and heterodimerizing substitutions K392D+K409D in the CH3 domain, while the other Fc chain has ADCC-enhancement substitutions L234Y+K290Y+Y296W in the lower hinge region and CH2 domain along with heterodimerizing substitutions E356K+D399K in the CH3 domain. The antibodies prefer to form heterodimers which can induce strong ADCC killing when specifically binding to the tumor cells with their Fab regions.

TABLE 2

Table 2: The amino acid residues located at the VH/VL and CH1/Cκ interfaces were selected for the introduction of charge pair residues.

| VH | | | | | | contact | VL | | | | | |
|---|---|---|---|---|---|---|---|---|---|---|---|---|
| IMGT # | Kabat # | Eu # | AHo # | FW | Residue | | IMGT # | Kabat # | Eu # | AHo # | FW | Residue |
| 44 | 39 | 39 | 46 | 2 | $Q_{IR/T}$ | ↔ | 44 | 38 | 38 | 46 | 2 | $Q_{IG/H/L}$ |
| 49 | 44 | 44 | 51 | 2 | $G_{IR/A}$ | ↔ | * | 100 | 100 | 141 | 4 | $Q_{IG/P}$ |
| * | 105 | 109 | 141 | 4 | $Q_{IK/R/S}$ | ↔ | 49 | 43 | 43 | 51 | 2 | $A_{IG/S/P}$ |

TABLE 2-continued

Table 2: The amino acid residues located at the VH/VL and CH1/Cκ interfaces were selected for the introduction of charge pair residues.

| $C_H1$ | | | | | | | Cκ | | | | | |
|---|---|---|---|---|---|---|---|---|---|---|---|---|
| IMGT # | Kabat # | Eu # | AHo # | Ref # | Residue | contact | IMGT # | Kabat # | Eu # | AHo # | Ref # | Residue |
| 20 | 139 | 141 | * | 176 | A | ↔ | 5 | 116 | 116 | * | 158 | F |
| 82 | 175 | 171 | * | 212 | P | ↔ | 81 | 162 | 162 | * | 211 | s |
| 86 | 188 | 183 | * | 230 | s | ↔ | 86 | 176 | 176 | * | 230 | s |
| 26 | 145 | 147 | * | 182 | K | ↔ | 13 | 124 | 124 | * | 166 | Q |
| 26 | 145 | 147 | * | 182 | K | ↔ | 20 | 131 | 131 | * | 176 | s |
| 26 | 145 | 147 | * | 182 | K | ↔ | 90 | 180 | 180 | * | 234 | T |

FW: Framework.
Germline residues of VH and VL are numbered by different numbering systems, the bolded residues are the dominant ones. The contact residues in VH/VL of most of antibodies are arrayed in the same row. Residues of human IgG1 CH1 domain contacting the residues in Cκ region are also bolded and laid in the same row.

In a proof-of-concept study, a Fn3 tag (12 KDa) was inserted at the N-terminus of anti-EGFr Ab2 HC and a Fn3-Flag-His6 tag (14 KDa) was fused in frame to the C-terminus of anti-EGFr Ab2 LC, so the 4 different combinations of LC/HC can be distinguished in SDS-PAGE gel by different sizes: 176 KDa for the wanted LC1/HC1::LC2-Fn3-FH/Fn3-HC2 or unwanted LC2-Fn3-FH/HC1::LC1/Fn3-HC2; 162 KDa for unwanted LC1/HC1::LC1/Fn3-HC2; and 190 KDa for unwanted LC2-Fn3-FH/HC1::LC2-Fn3-FH/Fn3-HC2. The composition of 176 KDa product was determined subsequently by Mass Spectrometry with partial reduction. A dual-antigen binding plate ELISA was utilized to screen the favorable variants having preferred LC/HC pairings.

Different variants (Table 3) were investigated to find the best combination with highest dual antigen binding and correct LC/HC pairing. When compared to the mono-specific anti-Her2 Ab1 (C01) or anti-EGFr Ab2 (C07), which did not generate any binding signal, and the internal control C11, which is made of four regular chains with random LC/HC pairings, variants 1C02, 1C04, 2A05, 2B04, 2B05 and 5D03 showed improved binding to dual antigens (Her2 and EGFr extracellular domain) in a dose-dependent manner. Variants 2B05 and 5D03 had the strongest binding as the curves shifted to the left most. These variants also had the dominant formation of full-length heterodimer IgG1 in the SDS-PAGE gel. Expression testing indicated that adding modifier XBP1 slightly boosted the expression level of heterodimeric antibody variants while another modifier ERP23 rarely boosted expression.

TABLE 3

Variants made by electrostatic steering mechanism.

| | anti-Her2 Ab1 HC (K392D + K409D) | | anti-Her2 Ab1 LC | |
|---|---|---|---|---|
| Variant | VH1 | CH1 | VL1 | CL |
| C12 | Q39K + G44K | | Q38D + Q100D | |
| C13 | Q39K + G44K | | Q38D + Q100D | |
| C14 | Q39K + G44K | | Q38D + Q100D | |
| C15 | Q39K + Q105K | | Q38D + A43D | |
| C16 | Q39K + Q105K | | Q38D + A43D | |
| C17 | Q39K + Q105K | | Q38D + A43D | |
| C18 | G44K + Q105K | | Q100D + A43D | |
| C19 | G44K + Q105K | | Q100D + A43D | |
| C20 | G44K + Q105K | | Q100D + A43D | |
| 1A01 | | K147K + S183K | | Q124D + S176D |
| 1A02 | | K147K + S183K | | Q124D + S176D |
| 1A03 | | K147K + S183K | | Q124D + S176D |
| 1A04 | | K147K + S183K | | S131D + S176D |
| 1A05 | | K147K + S183K | | S131D + S176D |
| 1A06 | | K147K + S183K | | S131D + S176D |
| 1B01 | | K147K + S183K | | S176D + T180D |
| 1B02 | | K147K + S183K | | S176D + T180D |
| 1B03 | | K147K + S183K | | S176D + T180D |
| 1B04 | Q39K + Q105K | K147D + S183D | Q38D + A43D | Q124K + S176K |
| 1B05 | Q39K + Q105K | K147D + S183D | Q38D + A43D | Q124K + S176K |
| 1B06 | Q39K + Q105K | K147D + S183D | Q38D + A43D | Q124K + S176K |
| 1C01 | Q39K + Q105K | K147D + S183D | Q38D + A43D | S131K + S176K |
| 1C02 | Q39K + Q105K | K147D + S183D | Q38D + A43D | S131K + S176K |
| 1C03 | Q39K + Q105K | K147D + S183D | Q38D + A43D | S131K + S176K |
| 1C04 | Q39K + Q105K | K147D + S183D | Q38D + A43D | S176K + T180K |
| 1C05 | Q39K + Q105K | K147D + S183D | Q38D + A43D | S176K + T180K |
| 1C06 | Q39K + Q105K | K147D + S183D | Q38D + A43D | S176K + T180K |
| 1D01 | | K147K | | Q124D |
| 1D02 | | K147K | | Q124D |
| 1D03 | | K147K | | Q124D |
| 1D04 | | K147K | | S131D |

TABLE 3-continued

Variants made by electrostatic steering mechanism.

| | | | | |
|---|---|---|---|---|
| 1D05 | | K147K | | S131D |
| 1D06 | | K147K | | S131D |
| 2A01 | | S183K | | S176D |
| 2A02 | | S183K | | S176D |
| 2A03 | | S183K | | S176D |
| 2A04 | Q39K + Q105K | K147D | Q38D + A43D | Q124K |
| 2A05 | Q39K + Q105K | K147D | Q38D + A43D | Q124K |
| 2A06 | Q39K + Q105K | K147D | Q38D + A43D | Q124K |
| 2B01 | Q39K + Q105K | K147D | Q38D + A43D | S131K |
| 2B02 | Q39K + Q105K | K147D | Q38D + A43D | S131K |
| 2B03 | Q39K + Q105K | K147D | Q38D + A43D | S131K |
| 2B04 | Q39K + Q105K | K147D | Q38D + A43D | T180K |
| 2B05 | Q39K + Q105K | K147D | Q38D + A43D | T180K |
| 2B06 | Q39K + Q105K | K147D | Q38D + A43D | T180K |
| 2C01 | Q39K + Q105K | S183D | Q38D + A43D | S176K |
| 2C02 | Q39K + Q105K | S183D | Q38D + A43D | S176K |
| 2C03 | Q39K + Q105K | S183D | Q38D + A43D | S176K |
| 5A01 | Q39K + Q105K | A141D | Q38D + A43D | F116K |
| 5A02 | Q39K + Q105K | A141D | Q38D + A43D | F116K |
| 5A03 | Q39K + Q105K | A141D | Q38D + A43D | F116K |
| 5A04 | Q39K + Q105K | A141D | Q38D + A43D | F116K |
| 5A05 | Q39K + Q105K | P171D | Q38D + A43D | S162K |
| 5A06 | Q39K + Q105K | P171D | Q38D + A43D | S162K |
| 5B01 | Q39K + Q105K | P171D | Q38D + A43D | S162K |
| 5B02 | Q39K + Q105K | P171D | Q38D + A43D | S162K |
| 5B03 | Q39K + Q105K | K147D | Q38D + A43D | S131K |
| 5B04 | Q39K + Q105K | K147D | Q38D + A43D | S131K |
| 5B05 | Q39K + Q105K | K147D | Q38D + A43D | S131K |
| 5B06 | Q39K + Q105K | K147D | Q38D + A43D | S131K |
| 5C01 | Q39K + Q105K | S183D | Q38D + A43D | S176K |
| 5C02 | Q39K + Q105K | S183D | Q38D + A43D | S176K |
| 5C03 | Q39K + Q105K | S183D | Q38D + A43D | S176K |
| 5C04 | Q39K + Q105K | S183D | Q38D + A43D | S176K |
| 5C05 | Q39K + Q105K | A141D | Q38D + A43D | F116K |
| 5C06 | Q39K + Q105K | A141D | Q38D + A43D | F116K |
| 5D01 | Q39K + Q105K | A141D | Q38D + A43D | F116K |
| 5D02 | Q39K + Q105K | A141D | Q38D + A43D | F116K |
| 5D03 | Q39K + Q105K | P171D | Q38D + A43D | S162K |
| 5D04 | Q39K + Q105K | P171D | Q38D + A43D | S162K |
| 5D05 | Q39K + Q105K | P171D | Q38D + A43D | S162K |
| 5D06 | Q39K + Q105K | P171D | Q38D + A43D | S162K |
| 6A01 | Q39K + Q105K | K147D | Q38D + A43D | S131K |
| 6A02 | Q39K + Q105K | K147D | Q38D + A43D | S131K |
| 6A03 | Q39K + Q105K | K147D | Q38D + A43D | S131K |
| 6A04 | Q39K + Q105K | K147D | Q38D + A43D | S131K |
| 6A05 | Q39K + Q105K | S183D | Q38D + A43D | S176K |
| 6A06 | Q39K + Q105K | S183D | Q38D + A43D | S176K |
| 6B01 | Q39K + Q105K | S183D | Q38D + A43D | S176K |
| 6B02 | Q39K + Q105K | S183D | Q38D + A43D | S176K |

| | anti-EGFr Ab2 HC (E356K + D399K) | | anti-EGFr Ab2 LC | |
|---|---|---|---|---|
| Variant | VH2 | CH1 | VL2 | CL |
| C12 | Q39D + G44D | | Q38K + G100K | |
| C13 | Q39D + Q105D | | Q38K + A43K | |
| C14 | G44D + Q105D | | G100K + A43K | |
| C15 | Q39D + G44D | | Q38K + G100K | |
| C16 | Q39D + Q105D | | Q38K + A43K | |
| C17 | G44D + Q105D | | G100K + A43K | |
| C18 | Q39D + G44D | | Q38K + G100K | |
| C19 | Q39D + Q105D | | Q38K + A43K | |
| C20 | G44D + Q105D | | G100K + A43K | |
| 1A01 | | K147D + S183D | | Q124K + S176K |
| 1A02 | | K147D + S183D | | S131K + S176K |
| 1A03 | | K147D + S183D | | S176K + T180K |
| 1A04 | | K147D + S183D | | Q124K + S176K |
| 1A05 | | K147D + S183D | | S131K + S176K |
| 1A06 | | K147D + S183D | | S176K + T180K |
| 1B01 | | K147D + S183D | | Q124K + S176K |
| 1B02 | | K147D + S183D | | S131K + S176K |
| 1B03 | | K147D + S183D | | S176K + T180K |
| 1B04 | G44D + Q105D | S183K | G100K + A43K | Q124D + S176D |
| 1B05 | G44D + Q105D | S183K | G100K + A43K | S131D + S176D |
| 1B06 | G44D + Q105D | S183K | G100K + A43K | S176D + T180D |
| 1C01 | G44D + Q105D | S183K | G100K + A43K | Q124D + S176D |
| 1C02 | G44D + Q105D | S183K | G100K + A43K | S131D + S176D |

TABLE 3-continued

Variants made by electrostatic steering mechanism.

| | | | | |
|---|---|---|---|---|
| 1C03 | G44D + Q105D | S183K | G100K + A43K | S176D + T180D |
| 1C04 | G44D + Q105D | S183K | G100K + A43K | Q124D + S176D |
| 1C05 | G44D + Q105D | S183K | G100K + A43K | S131D + S176D |
| 1C06 | G44D + Q105D | S183K | G100K + A43K | S176D + T180D |
| 1D01 | | K147D | | Q124K |
| 1D02 | | K147D | | S131K |
| 1D03 | | S183D | | S176K |
| 1D04 | | K147D | | Q124K |
| 1D05 | | K147D | | S131K |
| 1D06 | | S183D | | S176K |
| 2A01 | | K147D | | Q124K |
| 2A02 | | K147D | | S131K |
| 2A03 | | S183D | | S176K |
| 2A04 | G44D + Q105D | K147K | G100K + A43K | Q124D |
| 2A05 | G44D + Q105D | K147K | G100K + A43K | S131D |
| 2A06 | G44D + Q105D | S183K | G100K + A43K | S176D |
| 2B01 | G44D + Q105D | K147K | G100K + A43K | Q124D |
| 2B02 | G44D + Q105D | K147K | G100K + A43K | S131D |
| 2B03 | G44D + Q105D | S183K | G100K + A43K | S176D |
| 2B04 | G44D + Q105D | K147K | G100K + A43K | Q124D |
| 2B05 | G44D + Q105D | K147K | G100K + A43K | S131D |
| 2B06 | G44D + Q105D | S183K | G100K + A43K | S176D |
| 2C01 | G44D + Q105D | K147K | G100K + A43K | Q124D |
| 2C02 | G44D + Q105D | K147K | G100K + A43K | S131D |
| 2C03 | G44D + Q105D | S183K | G100K + A43K | S176D |
| 5A01 | Q39D + Q105D | A141K | Q38K + A43K | F116D |
| 5A02 | Q39D + Q105D | P171K | Q38K + A43K | S162D |
| 5A03 | Q39D + Q105D | K147K | Q38K + A43K | S131D |
| 5A04 | Q39D + Q105D | S183K | Q38K + A43K | S176D |
| 5A05 | Q39D + Q105D | A141K | Q38K + A43K | F116D |
| 5A06 | Q39D + Q105D | P171K | Q38K + A43K | S162D |
| 5B01 | Q39D + Q105D | K147K | Q38K + A43K | S131D |
| 5B02 | Q39D + Q105D | S183K | Q38K + A43K | S176D |
| 5B03 | Q39D + Q105D | A141K | Q38K + A43K | F116D |
| 5B04 | Q39D + Q105D | P171K | Q38K + A43K | S162D |
| 5B05 | Q39D + Q105D | K147K | Q38K + A43K | S131D |
| 5B06 | Q39D + Q105D | S183K | Q38K + A43K | S176D |
| 5C01 | Q39D + Q105D | A141K | Q38K + A43K | F116D |
| 5C02 | Q39D + Q105D | P171K | Q38K + A43K | S162D |
| 5C03 | Q39D + Q105D | K147K | Q38K + A43K | S131D |
| 5C04 | Q39D + Q105D | S183K | Q38K + A43K | S176D |
| 5C05 | G44D + Q105D | A141K | G100K + A43K | F116D |
| 5C06 | G44D + Q105D | P171K | G100K + A43K | S162D |
| 5D01 | G44D + Q105D | K147K | G100K + A43K | S131D |
| 5D02 | G44D + Q105D | S183K | G100K + A43K | S176D |
| 5D03 | G44D + Q105D | A141K | G100K + A43K | F116D |
| 5D04 | G44D + Q105D | P171K | G100K + A43K | S162D |
| 5D05 | G44D + Q105D | K147K | G100K + A43K | S131D |
| 5D06 | G44D + Q105D | S183K | G100K + A43K | S176D |
| 6A01 | G44D + Q105D | A141K | G100K + A43K | F116D |
| 6A02 | G44D + Q105D | P171K | G100K + A43K | S162D |
| 6A03 | G44D + Q105D | K147K | G100K + A43K | S131D |
| 6A04 | G44D + Q105D | S183K | G100K + A43K | S176D |
| 6A05 | G44D + Q105D | A141K | G100K + A43K | F116D |
| 6A06 | G44D + Q105D | P171K | G100K + A43K | S162D |
| 6B01 | G44D + Q105D | K147K | G100K + A43K | S131D |
| 6B02 | G44D + Q105D | S183K | G100K + A43K | S176D |

The amino acid changes in the VH/VL and CH1/CL interface of the anti-Her2 Ab1 and the anti-EGFr Ab2 as heterodimeric IgG1 where the HC of Ab1 has S298T + A330M + K334V in CH2 domain and K392D + K409D in CH3 domain; the HC of Ab2 has L234Y + K209Y + Y296W in lower hinge and CH2 domain and E356K + D399K in CH3 domain. An Fn3 tag was inserted at the N-terminus of anti-EGFr Ab2 HC and an Fn3-Flag-His6 tag was fused in frame to the C-terminus of anti-EGFr Ab2 LC. The residues in variable regions (VH or VL) are numbered by Kabat numbering system while residues in constant regions (CH1 or CL) are numbered by Eu numbering system.

Variants 1C02, 1C04, 2A05, 2B05 and 5D03 were made by transiently transfecting HEK 2936E cells, and purified with a Protein A column then polished with Superdex 200 Size-Exclusion Column. From 900 mL of supernatant, 1.2~6.8 mgs of final products with ~100% purity by analytical SEC were obtained. In the non-reduced SDA-PAGE gel (FIG. 4, left), all variants have a very dominant full-length IgG1 in which a Fn3 tag was inserted at the N-terminus of anti-EGFr Ab2 HC and a Fn3-Flag-His tag was fused in frame to the C-terminus of anti-EGFr Ab2 LC. Variants 2B05 and 5D03 are the purest with very minimal level of smaller bands. Under reduced condition, four different chains (Fn3-HC2 at 61KDa; HC1 at 50 KDa; LC2-Fn3-Flag-His6 at 36 KDa; LC1 at 23 KDa) were separated due to their different sizes. The four different chains were shown to be a 1:1:1:1 ratio in the assembled full-length IgG1 antibody. The components and correct LC/HC pairings were confirmed by mass spectrometry.

Example 9

Her2/EGFR Heterodimeric Antibodies Maintained Blocking Function of the Parent Antibodies This Example demonstrates that the heterodimeric antibodies described in Example 7 maintain the blocking function of the individual antibodies from which they were made. Moreover, the heterodimeric antibodies were capable of mediating ADCC against target-expressing cells.

In addition to dual antigen binding, variants 2B05 and 5D03 were chosen to test their functionality by a cell-based assay. A CHO cell line was stably transfected with human EGFr. When ligand EGF was added in the culture medium, the receptor EGFr on the CHO cell surface was activated and phosphorylated, turning on downstream signal pathways, such as MAPK, ERK1/2, PI3K, JAK/STAT, and PKC. The anti-EGFr antibody from which 2B05 and 5D03 were derived blocked the ligand EGF binding to the receptor EGFr and inhibited the phosphorylation of receptor EGFr at IC50=2.7 nM. The combo of anti-EGFr antibody and anti-Her2 antibody functioned similarly at IC50=3.2 nM. Anti-EGFr×Her2 heterodimeric antibody variants 2B05 and 5D03 both were comparable in the phosphorylation of receptor EGFr at IC50=4.2 nM and IC50=4.6 nM respectively, indicating the anti-EGFr Fab arm of heterodimeric antibody variants 2B05 and 5D03 was functioning comparable to the wild type anti-EGFr antibody.

BT474 is a human breast tumor cell line. BT474 cells express both Her2 (Erb2) and Her3 (Erb3) on the surface. Anti-Her2 antibodies can bind to domain IV of Her2, triggering internalization and degradation of receptors [Wehrman T S, et al. (2006) PNAS 103(50):19063-19068 and Buschenfelde C M et al (2002) Cancer Res 62(8):2244-2247]. The antibody thus blocks downstream signaling pathways [Yakes F M, et al. (2002) Cancer Res 62(14): 4132-4141 and Scotti M L et al (2008) Breast Cancer Res Treat 111(2):241-50], such as Raf/MEK 1&2/ERK 1&2 and PI3K/Akt pathways. The anti-Her2 antibody does not decrease Her2 phosphorylation but inhibits basal Her3 phosphorylation in BT474 cells. When no ligand is added in the culture medium of BT474 cells, the Her2 antibody alone blocked the phosphorylation of Her3 at IC50=2.8 nM. The combination of anti-EGFr antibody and anti-Her2 antibody functioned similarly at IC50=5.2 nM. Anti-EGFr×Her2 heterodimeric antibody variants 2B05 and 5D03 both inhibited the basal level phosphorylation of receptor Her3 at IC50=3.0 nM and IC50=3.6 nM respectively, indicating that the anti-Her2 arm was functioning.

The combined data from the above two different cell-based assays suggested that both arms of anti-EGFr×Her2 heterodimeric antibody variants 2B05 and 5D03 work properly in inhibiting the activation of EGFr and Her2.

Example 10

Her2/EGFR Heterodimeric Antibodies are Capable of Mediating ADCC Killing of Tumor Cells N87 is a human gastric tumor cell line expressing high levels of Her2 and moderate levels of EGFr. An irrelevant human IgG1 was used as a control. The anti-EGFr×Her2 heterodimeric antibody variants 2B05 and 5D03 have incorporated ADCC enhancement substitutions and heterodimerizing substitutions in their Fc regions. The ADCC assay was carried out to test whether the heterodimeric antibody variants bind to their specific antigens and induce killing of N87 cells. At 1 μg/mL the irrelevant human IgG1 control antibody had a background lysis of 30% and did not show a dose-dependent response when it was titrated down. Both variants 2B05 and 5D03 had much higher specific lysis at 1 μg/mL concentration and showed a dose-dependent response with EC50 at 0.10 pM and 0.19 pM respectively. The data demonstrates that the heterodimeric antibody variants 2B05 and 5D03 can bind to targets EGFr & Her2, and induce strong killing of N87 cells by engaging NK cells.

Example 11

Alternative Variants can Also Guide Correct LC/HC Pairings

Electrostatic steering can be combined with other steering technologies. For example, replacement of one charged-residue pair in VH/VL interface with a pair of cysteine residues was explored. The pair of cysteine residues are in close proximity (4~5.6 Å) to form disulfide bond, therefore locking the correctly paired LC/HC. Seven different combinations of charge-pair and Cys-Cys pair on the basis of variant 2B05 (Table 4) were made by transiently transfecting mammalian 2936E cells. Supernatants were separated by an SDS-PAGE gel. While the internal control C11 showed four different bands between 148 and 250 KDa, variants 2C04 and 2C06 dominantly produced the full-length IgG1; variant 2D04 which has different disulfide bonds at Q105C-A43C and G44C-G100C in separate Fab arms exclusively assembles into the full-length IgG1 antibody, implying that the combination of charge pair residues and cysteine pair residues can work cooperatively to make the correctly paired and folded heterodimeric antibody.

TABLE 4

Variants made by the combination of charge pair residues and Cysteine pair residues in the variable regions.

| | anti-Her2 Ab1 HC (K392D + K409D) | | anti-Her2 Ab1 LC | | anti-EGFr Ab2 HC (E356K + D399K) | | anti-EGFr Ab2 LC | |
|---|---|---|---|---|---|---|---|---|
| Variant | VH1 | $C_H1$ | VL1 | CL | VH2 | $C_H1$ | VL2 | CL |
| 2C04 | Q39C + Q105K | K147D | Q38C + A43D | T180K | G44D + Q105D | K147K | G100K + A43K | S131D |
| 2C05 | Q39K + Q105C | K147D | Q38D + A43C | T180K | G44D + Q105D | K147K | G100K + A43K | S131D |
| 2C06 | Q39K + Q105K | K147D | Q38D + A43D | T180K | G44C + Q105D | K147K | G100C + A43K | S131D |
| 2D01 | Q39K + Q105K | K147D | Q38D + A43D | T180K | G44D + Q105C | K147K | G100K + A43C | S131D |
| 2D02 | Q39C + Q105K | K147D | Q38C + A43D | T180K | G44D + Q105D | K147K | G100C + A43K | S131D |
| 2D03 | Q39C + Q105K | K147D | Q38C + A43D | T180K | G44D + Q105C | K147K | G100K + A43C | S131D |
| 2D04 | Q39K + Q105C | K147D | Q38D + A43C | T180K | G44C + Q105D | K147K | G100C + A43K | S131D |

The residues in variable regions (VH or VL) are numbered by Kabat numbering system while residues in constant regions (CH1 or CL) are numbered by Eu numbering system. A Fn3 tag is inserted at the N-terminus of anti-EGFr Ab2 HC and a Fn3-Flag-His6 tag is fused in frame to the C-terminus of anti-EGFr Ab2 LC.

Replacement of a pair of charged residues in VH/VL interface with a pair of bulky/small residues [Zamyatnin AA (1972) Prog. Biophos. Mol. Biol. 24:107-123; Chothia C (1975) J. Mol. Biol. 105:1-14] was also tested. The bulky/small residue pairs could exert a knob-into-hole effect, directing the correct LC/HC pairings in the combination of electrostatic steering mechanism. Bulky residues, for example, Tryptophan (W) has a volume of 227.8 Å 3 and an Accessible Surface Area of 255 Å 2; Tyrosine (Y) has a volume of 193.6 Å 3 and an Accessible Surface Area of 230 Å 2. Small residue Alanine (A) has only a volume of 88.6 Å 3 and an Accessible Surface Area of 115 Å 2 while Serine (S) is similarly having a volume of 89 Å 3 and an Accessible Surface Area of 115 Å 2. A series of 64 variants (Table 5) on the basis of heterodimeric antibody variant 2B05 were made and tested by Western blotting. Variants 3A01, 3A02, 3A03, 3A04, 3A05, 3A06, 3B01, 3B02, 3B03, 3B04, 8A03 and 8A04 exclusively show a single band after separation by an SDS-PAGE gel, indicating that the four different chains can assemble into a full-length heterodimeric antibody. Other variants had multiple bands after separation by an SDS-PAGE gel, suggesting that these LCs could have some issues in terms of pairing with their cognate HCs.

TABLE 5

Variants made by the combination of charge pair residues and bulky/small pair residues in the variable regions.

| | anti-Her2 Ab1 HC (K392D + K409D) | | anti-Her2 Ab1 LC | | anti-EGFr Ab2 HC (E356K + D399K) | | anti-EGFr Ab2 LC | |
|---|---|---|---|---|---|---|---|---|
| Variant | VH1 | CH1 | VL1 | CL | VH2 | CH1 | VL2 | CL |
| 3A01 | Q39A + Q105K | K147D | Q38W + A43S | T180K | G44D + Q105W | K147K | G100K + A43S | S131D |
| 3A02 | Q39A + Q105K | K147D | Q38Y + A43D | T180K | G44D + Q105W | K147K | G100K + A43S | S131D |
| 3A03 | Q39S + Q105K | K147D | Q38W + A43D | T180K | G44D + Q105W | K147K | G100K + A43S | S131D |
| 3A04 | Q39S + Q105K | K147D | Q38Y + A43D | T180K | G44D + Q105W | K147K | G100K + A43S | S131D |
| 3A05 | Q39K + Q105A | K147D | Q38D + A43W | T180K | G44D + Q105W | K147K | G100K + A43S | S131D |
| 3A06 | Q39K + Q105A | K147D | Q38D + A43Y | T180K | G44D + Q105W | K147K | G100K + A43S | S131D |
| 3B01 | Q39K + Q105S | K147D | Q38D + A43W | T180K | G44D + Q105W | K147K | G100K + A43S | S131D |
| 3B02 | Q39K + Q105S | K147D | Q38D + A43Y | T180K | G44D + Q105W | K147K | G100K + A43S | S131D |
| 3B03 | Q39W + Q105K | K147D | Q38A + A43D | T180K | G44D + Q105W | K147K | G100K + A43S | S131D |
| 3B04 | Q39W + Q105K | K147D | Q38S + A43D | T180K | G44D + Q105W | K147K | G100K + A43S | S131D |
| 3B05 | Q39Y + Q105K | K147D | Q38A + A43D | T180K | G44D + Q105W | K147K | G100K + A43S | S131D |
| 3B06 | Q39Y + Q105K | K147D | Q38S + A43D | T180K | G44D + Q105W | K147K | G100K + A43S | S131D |
| 3C01 | Q39K + Q105W | K147D | Q38D + A43S | T180K | G44D + Q105W | K147K | G100K + A43S | S131D |
| 3C02 | Q39K + Q105Y | K147D | Q38D + A43S | T180K | G44D + Q105W | K147K | G100K + A43S | S131D |
| 3C03 | Q39A + Q105K | K147D | Q38W + A43D | T180K | G44D + Q105Y | K147K | G100K + A43S | S131D |
| 3C04 | Q39A + Q105K | K147D | Q38Y + A43D | T180K | G44D + Q105Y | K147K | G100K + A43S | S131D |
| 3C05 | Q39S + Q105K | K147D | Q38W + A43D | T180K | G44D + Q105Y | K147K | G100K + A43S | S131D |
| 3C06 | Q39S + Q105K | K147D | Q38Y + A43D | T180K | G44D + Q105Y | K147K | G100K + A43S | S131D |
| 3D01 | Q39K + Q105A | K147D | Q38D + A43W | T180K | G44D + Q105Y | K147K | G100K + A43S | S131D |
| 3D02 | Q39K + Q105A | K147D | Q38D + A43Y | T180K | G44D + Q105Y | K147K | G100K + A43S | S131D |
| 3D03 | Q39K + Q105S | K147D | Q38D + A43W | T180K | G44D + Q105Y | K147K | G100K + A43S | S131D |
| 3D04 | Q39K + Q105S | K147D | Q38D + A43Y | T180K | G44D + Q105Y | K147K | G100K + A43S | S131D |
| 3D05 | Q39W + Q105K | K147D | Q38A + A43D | T180K | G44D + Q105Y | K147K | G100K + A43S | S131D |
| 3D06 | Q39W + Q105K | K147D | Q38S + A43D | T180K | G44D + Q105Y | K147K | G100K + A43S | S131D |
| 4A01 | Q39Y + Q105K | K147D | Q38A + A43D | T180K | G44D + Q105Y | K147K | G100K + A43S | S131D |
| 4A02 | Q39Y + Q105K | K147D | Q38S + A43D | T180K | G44D + Q105Y | K147K | G100K + A43S | S131D |
| 4A03 | Q39K + Q105W | K147D | Q38D + A43S | T180K | G44D + Q105Y | K147K | G100K + A43S | S131D |
| 4A04 | Q39K + Q105Y | K147D | Q38D + A43S | T180K | G44D + Q105Y | K147K | G100K + A43S | S131D |
| 7A01 | Q39A + Q105K | K147D | Q38W + A43D | T180K | G44D + Q105D | K147K | G100K + A43K | S131D |
| 7A02 | Q39A + Q105K | K147D | Q38Y + A43D | T180K | G44D + Q105D | K147K | G100K + A43K | S131D |
| 7A03 | Q39S + Q105K | K147D | Q38W + A43D | T180K | G44D + Q105D | K147K | G100K + A43K | S131D |
| 7A04 | Q39S + Q105K | K147D | Q38Y + A43D | T180K | G44D + Q105D | K147K | G100K + A43K | S131D |

TABLE 5-continued

Variants made by the combination of charge pair residues and bulky/small pair residues in the variable regions.

| | anti-Her2 Ab1 HC (K392D + K409D) | | anti-Her2 Ab1 LC | | anti-EGFr Ab2 HC (E356K + D399K) | | anti-EGFr Ab2 LC | |
|---|---|---|---|---|---|---|---|---|
| Variant | VH1 | CH1 | VL1 | CL | VH2 | CH1 | VL2 | CL |
| 7A05 | Q39K + Q105A | K147D | Q38D + A43W | T180K | G44D + Q105D | K147K | G100K + A43K | S131D |
| 7A06 | Q39K + Q105A | K147D | Q38D + A43Y | T180K | G44D + Q105D | K147K | G100K + A43K | S131D |
| 7B01 | Q39K + Q105S | K147D | Q38D + A43W | T180K | G44D + Q105D | K147K | G100K + A43K | S131D |
| 7B02 | Q39K + Q105S | K147D | Q38D + A43Y | T180K | G44D + Q105D | K147K | G100K + A43K | S131D |
| 7B03 | Q39W + Q105K | K147D | Q38A + M3D | T180K | G44D + Q105D | K147K | G100K + A43K | S131D |
| 7B04 | Q39W + Q105K | K147D | Q38S + A43D | T180K | G44D + Q105D | K147K | G100K + A43K | S131D |
| 7B05 | Q39Y + Q105K | K147D | Q38A + A43D | T180K | G44D + Q105D | K147K | G100K + A43K | S131D |
| 7B06 | Q39Y + Q105K | K147D | Q38S + A43D | T180K | G44D + Q105D | K147K | G100K + A43K | S131D |
| 7C01 | Q39K + Q105W | K147D | Q38D + A43S | T180K | G44D + Q105D | K147K | G100K + A43K | S131D |
| 7C02 | Q39K + Q105Y | K147D | Q38D + A43S | T180K | G44D + Q105D | K147K | G100K + A43K | S131D |
| 7C03 | Q39K + Q105K | K147D | Q38D + A43D | T180K | G44A + Q105D | K147K | G100W + A43K | S131D |
| 7C04 | Q39K + Q105K | K147D | Q38D + A43D | T180K | G44A + Q105D | K147K | G100Y + A43K | S131D |
| 7C05 | Q39K + Q105K | K147D | Q38D + A43D | T180K | G44S + Q105D | K147K | G100W + A43K | S131D |
| 7C06 | Q39K + Q105K | K147D | Q38D + A43D | T180K | G44S + Q105D | K147K | G100Y + A43K | S131D |
| 7D01 | Q39K + Q105K | K147D | Q38D + A43D | T180K | G44D + Q105A | K147K | G100K + A43W | S131D |
| 7D02 | Q39K + Q105K | K147D | Q38D + A43D | T180K | G44D + Q105A | K147K | G100K + A43Y | S131D |
| 7D03 | Q39K + Q105K | K147D | Q38D + A43D | T180K | G44D + Q105S | K147K | G100K + A43W | S131D |
| 7D04 | Q39K + Q105K | K147D | Q38D + A43D | T180K | G44D + Q105S | K147K | G100K + A43Y | S131D |
| 7D05 | Q39K + Q105K | K147D | Q38D + A43D | T180K | G44W + Q105D | K147K | G100A + A43K | S131D |
| 7D06 | Q39K + Q105K | K147D | Q38D + A43D | T180K | G44W + Q105D | K147K | G100S + A43K | S131D |
| 8A01 | Q39K + Q105K | K147D | Q38D + A43D | T180K | G44Y + Q105D | K147K | G100A + A43K | S131D |
| 8A02 | Q39K + Q105K | K147D | Q38D + A43D | T180K | G44Y + Q105D | K147K | G100S + A43K | S131D |
| 8A03 | Q39K + Q105K | K147D | Q38D + A43D | T180K | G44D + Q105W | K147K | G100K + A43S | S131D |
| 8A04 | Q39K + Q105K | K147D | Q38D + A43D | T180K | G44D + Q105Y | K147K | G100K + A43S | S131D |
| 8A05 | Q39A + Q105K | K147D | Q38W + A43D | T180K | G44W + Q105D | K147K | G100A + A43K | S131D |
| 8A06 | Q39A + Q105K | K147D | Q38W + A43D | T180K | G44Y + Q105D | K147K | G100A + A43K | S131D |
| 8B01 | Q39A + Q105K | K147D | Q38W + A43D | T180K | G44W + Q105D | K147K | G100S + A43K | S131D |
| 8B02 | Q39A + Q105K | K147D | Q38W + A43D | T180K | G44Y + Q105D | K147K | G100S + A43K | S131D |
| 8B03 | Q39W + Q105K | K147D | Q38A + A43D | T180K | G44A + Q105D | K147K | G100W + A43K | S131D |
| 8B04 | Q39W + Q105K | K147D | Q38A + A43D | T180K | G44A + Q105D | K147K | G100Y + A43K | S131D |
| 8B05 | Q39Y + Q105K | K147D | Q38A + M3D | T180K | G44A + Q105D | K147K | G100W + A43K | S131D |
| 8B06 | Q39Y + Q105K | K147D | Q38A + A43D | T180K | G44A + Q105D | K147K | G100Y + A43K | S131D |

The bulky residues here represent Tryptophan (W) or Tyrosine (Y) while the small residues represent Alanine (A) or Serine (S). The residues in variable regions (VH or VL) are numbered by Kabat numbering system while residues in constant regions (CH1 or CL) are numbered by Eu numbering system. A Fn3 tag is inserted at the N-terminus of anti-EGFr Ab2 HC and a Fn3-Flag-His6 tag is fused in frame to the C-terminus of anti-EGFr Ab2 LC.

Example 12

Optimization of Heterodimeric Antibodies in the Absence of Tags

The tags of anti-EGFr×Her2 variants 2B05 and 5D03 were removed and tested by either transfecting mammalian 2936E cells with four DNAs to make full-length antibody, or with only two DNAs to assess the tolerance of mismatched LC/HC pairings. When all four different chains were present, both variants produced the full-length antibody with a significant amount of half-antibody. Transfections with two plasmids encoding matched LC1+HC1 or LC2+HC2 also produced the full-length homodimer antibody with a significant amount of half-antibody. When the LC2 were mispaired with their non-cognate HC1 (LC2+HC1), there was small amount of products shown in the gel, whereas no products formed when LC1 was mis-paired with its non-cognate HC2 (LC1+HC2). The expression testing implied that LC2 of the anti-EGFr antibody is tolerated with HC1 of the anti-Her2 antibody, while LC1 of the anti-Her2 antibody is not tolerated with HC2 of the anti-EGFr antibody. To maximize the electrostatic steering effect, a series of new variants (Table 6) were investigated by introducing charge-pair residues at the same spatial position, but with opposite polarity. The LC/HC interfaces are mutually reciprocal, either repulsive when the same polarity residues come close, or attractive when the opposite polarity residues are in proximity.

Variants V15 and V20 were mainly expressed as the intact antibody after four different chains were transcribed and translated. In the presence of matched HC/LC (i.e. LC1+HC1 or LC2+HC2), half-antibody and homodimer full-length antibody were produced. When mismatched HC/LC (e.g. LC2+HC1) were co-expressed, no product was observed, suggesting that the LC2 was not compatible with HC1. However, LC1 was tolerated by HC2 to form either half-antibody or homodimer antibody, implying that the LC1 of V15 and V20 can pair with the non-cognate HC2 and get assembled then secreted. In contrast, variants V21, V23 and V25 were mainly expressed as the intact antibody after four different chains were transcribed and translated. In the presence of matched two chains (i.e. LC1+HC1 or LC2+HC2), a full IgG antibody was produced, indicating the LCs are compatible with their cognate HCs. In the presence of mismatched LC2+HC1 or LC1+HC2, no product was formed, suggesting that the LCs were not tolerated with the non-cognate HCs. Variant V22 was not as effective as V21, V23 and V25, as minor products were observed when the mismatched LCs were forced to pair with the non-cognate HCs. Mass spectrometry analysis demonstrated that variants V12, V21, V23, and V25 have the presence of four different chains (LC1+HC1+LC2+HC2) and correct LC/HC pairings (LC1+HC1 and LC2+HC2).

TABLE 6

The amino acid changes in the VH/VL and CH1/CL interface of anti-Her2 Ab1 and anti-EGFr Ab2 as heterodimeric IgG1 with mutual repulsive/attractive mechanism.

| | anti-Her 2Ab1 HC (K392D + K409D) | | anti-Her2 Ab1 LC | |
|---|---|---|---|---|
| Variant | VH1 | CH1 | VL1 | CL |
| V01 | Q39K + Q105K | K147D | Q38D + A43D | T180K |
| V02* | Q39K + Q105C | K147D | Q38D + A43C | T180K |
| V03 | Q39K + Q105K | P171D | Q38D + A43D | S162K |
| V04 | Q39K + Q105K | P171D | Q38D + A43D | S162K |
| V05 | Q39K + Q105K | P171D | Q38D + A43D | S162K |
| V06 | Q39K + Q105K | K147D | Q38D + A43D | T180K |
| V07 | Q39K | P171D | Q38D | S162K |
| V08 | Q39K | A141D | Q38D | F116K |
| V09 | Q39K | A141D | Q38D | F116K |
| V10 | Q39K | P171D | Q38D | S162K |
| V11 | Q105K | A141D | A43D | F116K |
| V12 | Q105K | P171D | A43D | S162K |
| V13 | Q105K | A141D | A43D | F116K |
| V14 | Q105K | P171D | A43D | S162K |
| V15 | Q39K | S183D | Q38D | S176K |
| V16 | Q105K | S183D | A43D | S176K |
| V17 | Q39K | S183D | Q38D | S176K |
| V18 | Q105K | S183D | A43D | S176K |
| V19 | Q39K | A141D + S183K | Q38D | F116K + S176D |
| V20 | Q39K | A141D + P171K | Q38D | F116K + S162D |
| V21 | Q39K + Q105K | K147D | Q38D + A43D | T180K |
| V22 | Q39K + Q105K | K147D | Q38D + A43D | T180K |
| V23 | Q39K + Q105K | S183D | Q38D + A43D | S176K |
| V24 | Q39K + Q105K | P171D | Q38D + A43D | S162K |
| V25 | G44K + Q105K | S183D | Q100D + A43D | S176K |

| | anti-EGFr Ab2 HC (E356K + D399K) | | anti-EGFr Ab2 LC | |
|---|---|---|---|---|
| Variant | VH2 | CH1 | VL2 | CL |
| V01 | G44D + Q105D | K147K | G100K + A43K | S131D |
| V02* | G44C + Q105D | K147K | G100C + A43K | S131D |
| V03 | G44D + Q105D | A141K | G100K + A43K | F116D |
| V04 | Q105D | A141K | A43K | F116D |
| V05 | Q39D + Q105D | A141K | Q38K + A43K | F116D |
| V06 | G44D + Q105D | | G100K + A43K | |
| V07 | Q39D | A141K | Q38K | F116D |
| V08 | Q39D | P171K | Q38K | S162D |
| V09 | Q39D | A141K | Q38K | F116D |
| V10 | Q39D | P171K | Q38K | S162D |
| V11 | Q105D | A141K | A43K | F116D |
| V12 | Q105D | P171K | A43K | S162D |
| V13 | Q105D | P171K | A43K | S162D |
| V14 | Q105D | A141K | A43K | F116D |
| V15 | Q39D | S183K | Q38K | S176D |
| V16 | Q105D | S183K | A43K | S176D |
| V17 | Q105D | S183K | A43K | S176D |
| V18 | Q39D | S183K | Q38K | S176D |
| V19 | Q39D | A141K + S183D | Q38K | F116D + S176K |
| V20 | Q39D | A141K + P171D | Q38K | F116D + S162K |
| V21 | Q39D + Q105D | K147K | Q38K + A43K | T180D |
| V22 | Q39D + Q105D | K147K | Q38K + A43K | S131D |
| V23 | Q39D + Q105D | S183K | Q38K + A43K | S176D |
| V24 | Q39D + Q105D | P171K | Q38K + A43K | S162D |
| V25 | G44D + Q105D | S183K | G100K + A43K | S176D |

The HC of anti-Her2 Ab1 has S298T + A330M + K334V in CH2 domain and K392D + K409D in CH3 domain; the HC of anti-EGFr Ab2 has L234Y + K209Y + Y296W in lower hinge/CH2 domain and E356K + D399K in CH3 domain. The residues in variable regions (VH or VL) are numbered by Kabat numbering system while residues in constant regions (CH1 or CL) are numbered by Eu numbering system.

Example 13

Optimized EGFR/her2 Heterodimeric Antibody Variants Showed Thermal Stability The temperature-induced unfolding of anti-EGFr IgG2, anti-Her2 IgG1, anti-Her2 defucosylated IgG1 and four anti-EGFr×Her2 heterodimeric antibody variants, under the same solvent conditions were assessed by differential scanning calorimetry (DSC). The thermogram of each protein consisted of 2 or 3 transitions. Wild-type anti-Her2 antibody showed a Tm of Fab/CH3 at 82° C. and a Tm of CH2 at 72° C.; an afucosylated version of the anti-Her2 antibody did not change the Tm of separate domains but decreased the enthalpy slightly. The anti-EGFr antibody had a similar profile of temperature-induced unfolding. All four anti-EGFr×Her2 heterodimeric antibody variants had slightly decreased Tm of CH2/CH3 at 68° C. as they all have the ADCC-enhancement substitutions in CH2 domains and heterodimerizing substitutions in the CH3 domain. In terms of Tm of Fab domains, variant V12 and V24 had the most significant decrease from 82° C. to 72° C.; variant V25 had two separate peaks at 72° C. and 78° C. while variant V23 had a single peak at 78° C. Overall, the four heterodimeric antibody variants showed good thermal stability. The data suggested the selected positions for introducing charge pair residues in the Fab regions impact on the stability of intact heterodimeric antibody to some extent, with Tm of separate domains above 68° C.

Example 14

Heterodimeric Antibodies Targeting Two Different Epitopes of the Same Antigen In order to show that the same approach of making heterodimeric antibodies can be applied to different antibodies, a heterodimeric IgG was generated from two different anti-Her2 antibodies. One antibody binds to the domain IV of Her2 whereas the other binds to domain II of Her2. Variant V23 (Table 6) in which two pairs of charge residues in VH/VL and one pair of charge residues in CH1/CL were reciprocally introduced was tested by either transfecting with four DNAs to make full-length antibody, or with only two DNAs to assess the tolerance of mismatched LC/HC pairings. Similarly to anti-EGFr×Her heterodimeric antibody variant V23, the anti-Her2×Her2 heterodimeric antibody V23 was mainly expressed as the intact antibody after four different chains were translated and assembled. In the presence of two matched chains (i.e. LC1+HC1 or LC2+ HC2), half-antibody and homodimer antibody were produced, indicating that the LCs are compatible with their cognate HCs. In the presence of mismatched chains LC2+ HC1 or LC1+HC2, absolutely no product was formed, suggesting that the LCs were not tolerated with their non-cognate HCs.

Example 15

Different Combinations of Charged Residues Affect Heterodimeric Antibody Expression and LC/HC Pairings To investigate whether different combinations of charge residues leads to different expression level or affects the LC/HC pairings, several anti-Her2×Her2 heterodimeric antibody variants were made by introducing charge pair residues with different combinations at the same locations (Table 7). While V23B had correct LC/HC pairings like V23A, but the expression level went down either in the form of intact antibody or half antibody. However, V23C and V23D tolerated the mispairing of LC/HC. All together, this set of data suggested that the electrostatic steering is not the only factor to guide the correct LC/HC pairings; other mechanisms such as shape complimentary may play a role in the process.

TABLE 7

Comparison of different charge pair combinations at the same position of VH/VL and CH1/CL interfaces.

| Variant | anti-Her2 Ab1 HC (K392D + K409D) VH1 | CH1 | anti-Her2 Ab1 LC VL1 | CL | anti-Her2 Ab2 HC (E356K + D399K) VH2 | CH1 | anti-Her2 Ab2 LC VL2 | CL |
|---|---|---|---|---|---|---|---|---|
| V23A | Q39K + Q105K | S183D | Q38D + A43D | S176K | Q39D + Q105D | S183K | Q38K + A43K | S176D |
| V23B | Q39D + Q105K | S183K | Q38K + A43D | S176D | Q39K + Q105D | S183D | Q38D + A43K | S176K |
| V23C | Q39K + Q105D | S183K | Q38D + A43K | S176D | Q39D + Q105K | S183D | Q38K + A43D | S176K |
| V23D | Q39D + Q105D | S183K | Q38K + A43K | S176D | Q39K + Q105K | S183D | Q38D + A43D | S176K |

The residues in variable regions (VH or VL) are numbered by Kabat numbering system while residues in constant regions (CH1 or CL) are numbered by Eu numbering system. The HC of anti-Her2 Ab1 has ADCC-enhancement substitutions S298T + A330M + K334V in CH2 domain and heterodimerizing changes K392D + K409D in CH3 domain; the HC of anti-Her2 Ab2 has ADCC-enhancement substitutions L234Y + K209Y + Y296W in lower hinge/CH2 domain and heterodimerizing changes E356K + D399K in CH3 domain.

Example 16

Stability and Viscosity Studies

Stability studies were conducted for a compositions comprising representative heterodimeric antibodies described herein, and features of the antibody composition were compared to comparable DVD (dual variable domain) antibody compositions. Antibody samples were stored at 4° C. or 40° C. in an A52Su formulation (i.e., 10 mM Acetate, 9% Sucrose, pH 5.2) for a period of two weeks or two months. Antibody aggregation was measured as a surrogate for stability using, e.g., SE-HPLC, CEX-HPLC, HIAC (sub-visible particle), and visual inspection. The results are summarized as percent of the monomeric peak (i.e., 100% would indicate no observed aggregation) in Table 8.

TABLE 8

| Antibody type | Antibody Name | % monomeric peak at 4° C. for two weeks | % monomeric peak at 40° C. for two weeks |
|---|---|---|---|
| hetero-Ig | Ab-5-6.147v1 | 99.2 | 95.3 |
| hetero-Ig | Ab-23-6.147v1 | 99.6 | 98.0 |
| hetero-Ig | Ab-23-6.147v2 | 99.7 | 98.7 |
| hetero-Ig | Ab-5-6.37.5v1 | 99.6 | 96.1 |

TABLE 8-continued

| Antibody type | Antibody Name | % monomeric peak at 4° C. for two weeks | % monomeric peak at 40° C. for two weeks |
|---|---|---|---|
| hetero-Ig | Ab-23-6.37.5v1 | 99.6 | 98.7 |
| DVD | Ab-23-6.147 | N/A | 62 |
| DVD | Ab-5-6.147 | N/A | 15 |
| DVD | Ab-23-6.37.5 | N/A | 89 |
| DVD | Ab-20C3-6.147 | N/A | 53 |

As demonstrated by the results set forth in Table 8, less than 5% of the hetero-Ig antibodies in A52Su formed aggregates when stored at 40° C. for two weeks compared to the DVD antibodies tested, where 11%-85% of the DVD antibodies in A52Su formed aggregates when stored under similar conditions. When stored at 4° C. for two weeks, less than 1% of the hetero-Ig antibodies tested formed aggregates.

A separate study was performed to investigate the relationship between viscosity and varying concentrations (70 mg/mL or 150 mg/mL) of the DVD and heterodimeric antibodies in the A52Su formulation. Viscosity was measured using a rheometer with the cone/plate geometry (RV III+ model, Brookfield Engineering Labs, Inc., Middleboro, Mass.). Sample temperature was maintained at 25° C. during measurement with a water bath. The spindle speed ranged from 15 to 125 rpm with 10 rpm increments. Data collection was carried out with Rheocalc™ software, version 2.7. The viscosity measurements of the various antibodies tested in A52Su formulations are provided below in Table 9.

TABLE 9

| Antibody type | Antibody Name | Viscosity (cP) at 70 mg/mL | Viscosity (cP) at 150 mg/mL |
|---|---|---|---|
| hetero-Ig | Ab-5-6.147v1 | 4.5 | 35.7 |
| hetero-Ig | Ab-23-6.147v1 | 3.5 | 15.6 |
| hetero-Ig | Ab-23-6.147v2 | 4.2 | 16.8 |
| hetero-Ig | Ab-5-6.37.5v1 | 3.1 | 51.5 |
| hetero-Ig | Ab-23-6.37.5v1 | 2.1 | 13.7 |
| DVD | Ab-23-6.147 | 4.3 | 94 |
| DVD | Ab-5-6.147 | 4.4 | 65 |
| DVD | Ab-23-6.37.5 | 4.6 | 43 |
| DVD | Ab-20C3-6.147 | 4.6 | 15 |

As shown in Table 9, the viscosity of each of the compositions comprising one of the tested heterodimeric or DVD antibodies (70 mg/mL) was less than 6 cP. When the heterodimeric antibody was present in the composition at a concentration of 150 mg/mL, three of the compositions had a viscosity of less than 17 cP. In contrast to the heterodimeric antibody formulations, only one DVD antibody formulation had a viscosity of less than 16 cP when the DVD antibody was present at a concentration of 150 mg/mL.

The foregoing Example demonstrates that the heterodimeric antibodies described herein are more stable (i.e., less than 1% of the antibody in the composition form aggregates when stored under 4° C. for two weeks) than the bispecific DVD antibodies tested. Formulations comprising such heterodimeric antibodies also met preferred viscosity specifications, and thus are particularly suitable for large scale manufacturing.

Example 17

Heterodimeric Antibodies Targeting Sclerostin and DKK1 Promote Bone Anabolism in Primates To demonstrate that heterodimeric antibodies targeting sclerostin and DKK1 promote bone anabolism in primates, a 9-week PK/PD study was conducted in forty naïve 4 to 6 year old cynomolgus female monkeys The animals were split into three groups, each group being administered a different heterodimeric antibody.

A total of three doses were administered to each group of animals every two weeks (an IV dose of 25 mg/kg was administered day 1 and day 15 followed by one 25 mg/kg subcutaneous dose at day 43). Blood was drawn several times over the course of the study. Serum was spun down, aliquoted, and frozen for subsequent analyses. Controls included untreated animals and animals treated with either a single anti-sclerostin antibody (Ab-5) or a neutralizing heterodimeric antibody directed against sclerostin and DKK1 (version 1) or a dual variable domain (DVD) antibody against sclerostin and DKK1 (6.147-AbL-Ab23). All animals were randomized at baseline using serum bone formation marker measurements (CICP, BSAP and Osteocalcin) and body weight.

Serum samples from the initial forty animals were collected for pre-screen bone turnover marker (BTM) evaluation. Twenty three animals were selected and assigned to the treatment groups based on the balanced biomarker profile and body weight. There were no significant differences between groups for all the BTM concentrations at baseline (BL) prescreen (Table 10).

TABLE 10

| | Serum BTM protein concentrations at BL prescreen | | | | |
|---|---|---|---|---|---|
| BL prescreen | TRACP 5b (U/L) Mean ± SEM | OC (ng/ml) Mean ± SEM | BAP (U/L) Mean ± SEM | C1CP (ng/ml) Mean ± SEM | DKK1 (pg/ml) Mean ± SEM |
| All n = 40 | 8.3 ± 0.6 | 24.9 ± 1.4 | 221.5 ± 13.0 | 90.5 ± 8.1 | 907.5 ± 42.3 |
| Controls n = 2 | 7.0 ± 2.6 | 28.7 ± 12.0 | 167.1 ± 41.9 | 83.9 ± 53.0 | 969.3 ± 456.3 |
| 1/Ab-5 n = 3 | 6.9 ± 0.6 | 23.9 ± 5.6 | 216.8 ± 64.9 | 78.6 ± 13.7 | 1004.8 ± 157.0 |
| 2/6.147-AbL-Ab23, n = 4 | 11.1 ± 4.6 | 21.0 ± 3.3 | 219.1 ± 30.4 | 83.2 ± 22.6 | 949.6 ± 153.4 |
| 3/Ab-23-6.37.5.v.1 n = 3 | 8.1 ± 1.8 | 25.0 ± 2.7 | 202.8 ± 36.2 | 73.6 ± 29.8 | 837.6 ± 55.2 |
| 4/Ab-5-6.37.5.v.1 n = 4 | 5.5 ± 0.2 | 22.6 ± 2.3 | 179.5 ± 22.8 | 90.7 ± 20.6 | 790.9 ± 75.9 |
| 5/Ab-5-6.147.v.1 n = 3 | 7.2 ± 1.1 | 25.6 ± 2.4 | 264.8 ± 62.4 | 64.4 ± 9.0 | 895.5 ± 173.0 |

Figure 9:
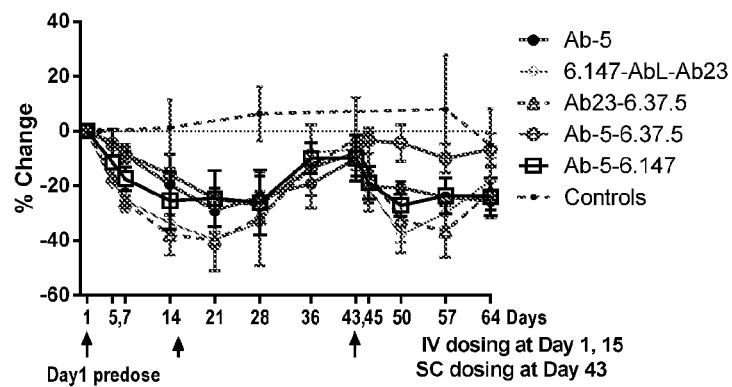
FIG. 9 is a graph depicting the percent change in absolute serum tartrate-resistant acid phosphatase 5b (TRACP 5b) concentration (y-axis) over time (x-axis) in cynomologous monkeys receiving 25 mg/kg Ab-5, DVD antibody 6.147-AbL-Ab23, heterodimeric antibody Ab23-6.37.5.v.1, heterodimeric antibody Ab5-6.37.5.v.1 and heterodimeric antibody Ab5-6.147.v.1 at day 1 (IV), day 15 (IV) and day 43 (SC).

Absolute serum tartrate-resistant acid phosphatase 5b (TRACP 5b) data are shown in Table 11. TRACP is an enzyme that is expressed in high amounts by bone resorbing osteoclasts. It has been demonstrated that TRACP 5b is useful as a marker of osteoclast number and bone resorption. See, Halleen et al., Clin. Lab., 52:499-509, 2006, the disclosure of which if is incorporated herein by reference in its entirety. Analysis of TRACP 5b percent change relative to predose (Table 11 and FIG. 9) revealed that DVD antibody 6.147-AbL-Ab23 and heterodimetic antibody Ab-23-6.37.5) treatments led to significant decrease in TRACP 5b (compared to the Ab-5-treated animals) at days 5 and 7.

TABLE 11

Serum TRACP 5b (% change from Day 1 predose)

TRACP 5b (% change from Day 1 predose)

| Time point of study | Gr 0 Controls n = 2 Mean ± SEM | Gr 1 Ab-5 n = 3 Mean ± SEM | Gr 2 Ab-2 n = 4 Mean ± SEM | Gr 3 Ab-23-6.37.5 n = 3 Mean ± SEM | Gr 4 Ab-5-6.37.5 n = 4 Mean ± SEM | Gr 5 Ab-5-6.147 n = 3 Mean ± SEM |
|---|---|---|---|---|---|---|
| Day 5 | N/A | −4.2 ± 5.0 | −19.1 ± 1.7** | −16.7 ± 1.8* | −5.0 ± 0.7 | −11.4 ± 2.2 |
| Day 7 | N/A | −8.8 ± 2.9 | −25.3 ± 4.1* | −25.9 ± 2.2* | −8.4 ± 3.5 | −17.5 ± 4.3 |
| Day 14 | 1.2 ± 10.2 | −19.5 ± 11.1 | −33.6 ± 3.2 | −38.0 ± 7.4 | −15.8 ± 2.2 | −25.5 ± 10.2 |
| Day 21 | N/A | −29.0 ± 8.3 | −39.9 ± 3.1 | −39.8 ± 11.4 | −24.8 ± 2.6 | −24.6 ± 10.3 |
| Day 28 | 6.3 ± 10.0 | −24.2 ± 7.7 | −33.5 ± 1.9 | −32.0 ± 17.1 | −27.0 ± 5.1 | −26.1 ± 11.9 |
| Day 36 | N/A | −19.3 ± 4.2 | −7.8 ± 3.7 | −13.0 ± 15.3 | −13.4 ± 5.6 | −9.9 ± 5.7 |
| Day 43 | N/A | −10.1 ± 6.3 | −6.9 ± 3.5 | −2.9 ± 15.1 | −8.1 ± 6.1 | −9.9 ± 8.3 |
| Day 45 | N/A | −20.6 ± 5.6 | −20.7 ± 3.1 | −15.0 ± 14.4 | −3.5 ± 4.8 | −18.9 ± 6.1 |
| Day 50 | N/A | −20.7 ± 2.3 | −37.9 ± 2.7 | −32.4 ± 12.0 | −4.3 ± 6.7 | −27.1 ± 4.0 |
| Day 57 | 8.0 ± 20.0 | −24.1 ± 1.3 | −30.0 ± 5.1 | −36.7 ± 9.4 | −9.9 ± 5.4 | −23.7 ± 6.5 |
| Day 64 | −5.2 ± 13.4 | −25.6 ± 3.1 | −18.2 ± 8.1 | −22.4 ± 9.4 | −6.7 ± 5.8 | −24.0 ± 6.9 |

*$p < 0.05$,
**$p < 0.01$ compared to Gr. 1

Figure 10:
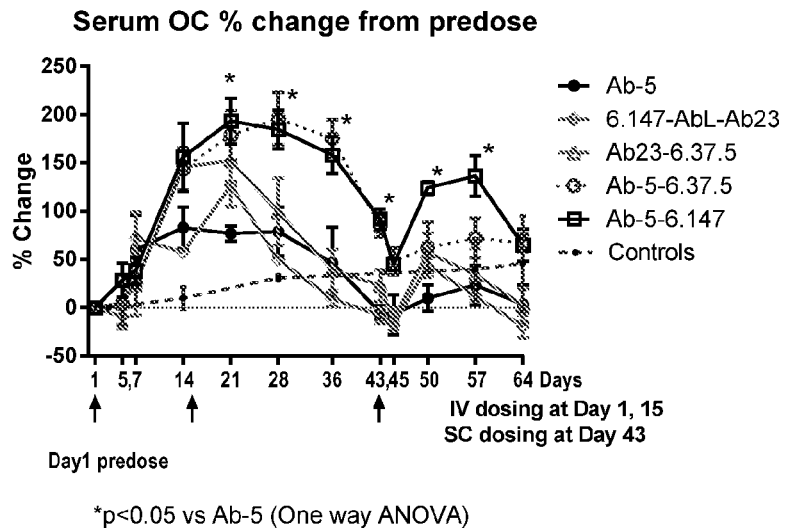
FIG. 10 is a graph depicting the percent change in serum osteocalcin (OC) concentrations (y-axis) in cynomologous monkeys over time (x-axis) receiving 25 mg/kg Ab-5, DVD antibody 6.147-AbL-Ab23, heterodimeric antibody Ab23-6.37.5.v.1, heterodimeric antibody Ab5-6.37.5.v.1 and heterodimeric antibody Ab5-6.147.v.1 at day 1 (IV), day 15 (IV), and day 43 (SC).

Serum osteocalcin (OC) concentrations (Table 12 and FIG. 10) of heterodimeric antibody Ab-5-6.147 were significantly higher compared with the Ab-5-treated animals at days 36, 43, and 57 of the study. Analysis of changes in serum OC relative to predose (Table 10 and FIG. 9) revealed that heterodimeric antibody Ab-23-6.37.5 treatment led to significant elevation of this analyte for tested time points from day 21 to day 45. Treatment with heterodimeric antibody Ab-5-6.147 resulted in significantly increased OC from day 21 to day 43 and for days 50 and 57 compared to the Ab-5-6.147-treated animals.

TABLE 12

Serum OC (% change from Day 1 predose)

OC (% change from Day 1 predose)

| Time point of study | Gr 0 Controls n = 2 Mean ± SEM | Gr 0 Ab-5 n = 3 Mean ± SEM | Gr 2 Ab-2 n = 4 Mean ± SEM | Gr 3 Ab-14-6.37.5 n = 3 Mean ± SEM | Gr 4 Ab-5-6.37.5 n = 4 Mean ± SEM | Gr 5 Ab-5-6.147 n = 3 Mean ± SEM |
|---|---|---|---|---|---|---|
| Day 5 | N/A | 3.1 ± 0.5 | −9.2 ± 11.8 | 5.4 ± 27.3 | 4.0 ± 21.5 | 28.6 ± 17.5 |
| Day 7 | N/A | 59.9 ± 36.1 | 71.8 ± 27.6 | 24.2 ± 32.1 | 26.7 ± 24.5 | 38.7 ± 14.2 |
| Day 14 | 10.2 ± 11.8 | 83.0 ± 21.4 | 57.5 ± 5.3 | 146.0 ± 6.5 | 143.7 ± 22 | 156.2 ± 35.4 |
| Day 21 | N/A | 76.8 ± 8.0 | 127 ± 21.8 | 152.1 ± 21.8 | 178.5 ± 25.6* | 193.4 ± 23.7* |
| Day 28 | 31.2 ± 3.4 | 78.9 ± 25.2 | 49.5 ± 4.5 | 99.3 ± 34.7 | 195.9 ± 27.0* | 184.5 ± 20.2* |
| Day 36 | N/A | 46.3 ± 37.4 | 9.3 ± 7.8 | 39.2 ± 21.2 | 175.5 ± 19.2** | 158.2 ± 19.3* |
| Day 43 | N/A | −5.0 ± 7.0 | −7.9 ± 8.1 | 23.0 ± 16.3 | 83.7 ± 10.4*** | 91.9 ± 10.9*** |
| Day 45 | N/A | −7.2 ± 20.5 | −18.0 ± 6.3 | −11.9 ± 11.7 | 48.2 ± 14.1* | 44.8 ± 2.2 |
| Day 50 | N/A | 10.1 ± 13.4 | 43.9 ± 11.9 | 57.1 ± 20.3 | 62.6 ± 25.7 | 124.1 ± 6.8** |
| Day 57 | 39.9 ± 31.8 | 23.3 ± 20.8 | 12.0 ± 3.4 | 34.4 ± 26.6 | 72.4 ± 20.2 | 136.7 ± 21.1** |
| Day 64 | 46.2 ± 49.2 | 3.6 ± 20.0 | −19.4 ± 12.0 | 2.6 ± 16.8 | 66.9 ± 8.9 | 65.1 ± 16.7 |

*$p < 0.05$,
**$p < 0.01$,
***$p < 0.001$ compared to Gr. 1

Figure 11:
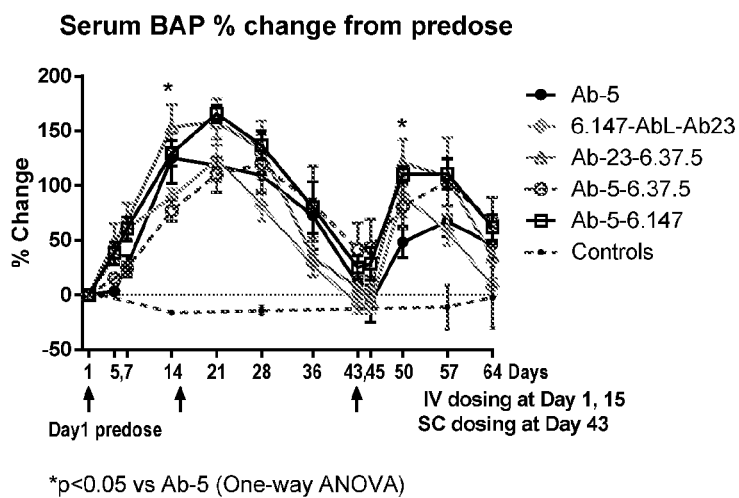
FIG. 11 is a graph depicting the percent change in serum bone alkaline phosphatase (BAP) concentrations (y-axis) in cynomologous monkeys over time (x-axis) receiving 25 mg/kg Ab-5, DVD antibody 6.147-AbL-Ab23, heterodimeric antibody Ab23-6.37.5.v.1, heterodimeric antibody Ab5-6.37.5.v.1 and heterodimeric antibody Ab5-6.147.v.1 at day 1 (IV), day 15 (IV), and day 43 (SC)

Serum bone alkaline phosphatase (BAP) percent change over predose was analyzed, the results of which are shown in Table 13 and FIG. 11. Results indicated that BAP was significantly elevated (vs Ab-5 group) in heterodimeric antibody Ab-23-6.37.5 treated animals at day 5.

TABLE 13

Serum BAP (% change from Day 1 predose)

| Time point of study | Gr 0 Controls n = 2 Mean ± SEM | Gr 1 Ab-5 n = 3 Mean ± SEM | Gr 2 Ab-2 n = 4 Mean ± SEM | Gr 3 Ab-23-6.37.5 n = 3 Mean ± SEM | Gr 4 Ab-5-6.37.5 n = 4 Mean ± SEM | Gr 5 Ab-5-6.147 n = 3 Mean ± SEM |
|---|---|---|---|---|---|---|
| Day 5 | N/A | 3.5 ± 0.8 | 35.2 ± 6.4 | 47.9 ± 17.2* | 15.1 ± 4.6 | 38.5 ± 10.3 |
| Day 7 | N/A | 26.6 ± 9.6 | 60.7 ± 9.3 | 67.7 ± 16.7 | 24.2 ± 6.3 | 60.6 ± 11.0 |
| Day 14 | −15.9 ± 2.1*** | 125.2 ± 23.1 | 89.4 ± 8.0 | 153.6 ± 20.6 | 77.3 ± 9.8 | 129.8 ± 11.8 |
| Day 21 | N/A | 118.7 ± 24.4 | 123.7 ± 20.2 | 158.1 ± 21.3 | 110.2 ± 16.5 | 165.7 ± 8.1 |
| Day 28 | −14.3 ± 4.0* | 109.2 ± 15.9 | 82.2 ± 14.5 | 133.4 ± 26.0 | 119.8 ± 27.2 | 136.8 ± 13.4 |
| Day 36 | N/A | 72.5 ± 30.9 | 27.5 ± 10.1 | 34.6 ± 17.8 | 83.7 ± 34.5 | 80.0 ± 23.9 |
| Day 43 | N/A | 10.4 ± 19.7 | −8.6 ± 8.0 | 6.6 ± 9.7 | 41.6 ± 24.7 | 25.5 ± 10.7 |
| Day 45 | N/A | −7.6 ± 17.1 | −9.9 ± 7.4 | 3.7 ± 10.5 | 43.7 ± 25.9 | 28.4 ± 15.1 |
| Day 50 | N/A | 48.7 ± 14.7 | 90.4 ± 19.1 | 121.3 ± 21.6 | 80.9 ± 20.5 | 110.5 ± 7.2 |
| Day 57 | −11.0 ± 20.2 | 67.3 ± 14.1 | 59.5 ± 14.3 | 108.0 ± 35.9 | 103.9 ± 21.6 | 110.7 ± 13.5 |
| Day 64 | −2.3 ± 28.5 | 46.4 ± 16.3 | 7.5 ± 7.9 | 35.2 ± 26.3 | 66.9 ± 22.5 | 62.3 ± 11.8 |

*p < 0.05,

***p < 0.001 compared to Gr. 1

Figure 12:
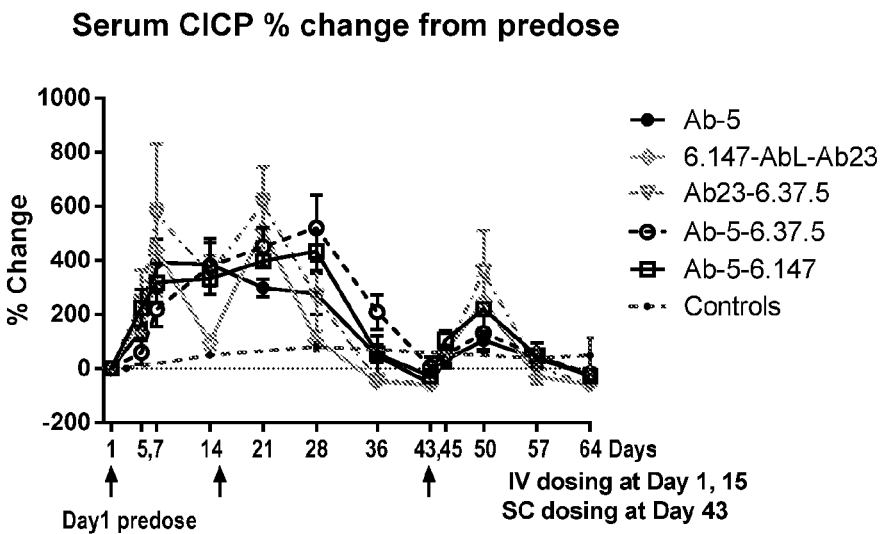
FIG. 12 is a graph depicting the percent change in serum C1CP concentrations (y-axis) in cynomologous monkeys over time (x-axis) receiving Ab-5, DVD antibody 6.147-AbL-Ab23, heterodimeric antibody Ab23-6.37.5.v.1, heterodimeric antibody Ab5-6.37.5.v.1 and heterodimeric antibody Ab5-6.147.v.1 at day 1 (IV), day 15 (IV), and day 43 (SC).

Serum C1CP data are presented in Table 14. The DVD antibody 6.147-AbL-Ab23 treated group had significantly lower C1CP percent change over predose (Table 14 and FIG. 12) compared to the Ab-5-treated animals at day 14.

TABLE 14

Serum C1CP (% change from Day 1 predose)

| Time point of study | Gr 0 Controls n = 2 Mean ± SEM | Gr 1 Ab-5 n = 3 Mean ± SEM | Gr 2 Ab-2 n = 4 Mean ± SEM | Gr 3 Ab-23-6.37.5 n = 3 Mean ± SEM | Gr 4 Ab-5-6.37.5 n = 4 Mean ± SEM | Gr 5 Ab-5-6.147 n = 3 Mean ± SEM |
|---|---|---|---|---|---|---|
| Day 5 | N/A | 140.9 ± 31.9 | 197.1 ± 67.6 | 246.0 ± 119.2 | 59.6 ± 42.9 | 224.6 ± 67.5 |
| Day 7 | N/A | 392.0 ± 87.6 | 439.3 ± 168.8 | 569.2 ± 263.6 | 218.2 ± 64.2 | 317.5 ± 72.1 |
| Day 14 | 49.8 ± 7.2* | 386.9 ± 80.9 | 96.0 ± 27.4* | 346.3 ± 70.7 | 377.1 ± 103.8 | 332.3 ± 26.8 |
| Day 21 | N/A | 298.7 ± 33 | 515.2 ± 129.3 | 609.6 ± 135.7 | 450.3 ± 72.5 | 397.5 ± 11.2 |
| Day 28 | 80.9 ± 15.7 | 276.8 ± 76.7 | 103.4 ± 21.7 | 267.2 ± 130.4 | 519.3 ± 122.3 | 433.0 ± 71.1 |
| Day 36 | N/A | 46.6 ± 74.4 | −49.0 ± 7.0 | −44.9 ± 8.9 | 208.6 ± 64.5 | 54.4 ± 32.6 |
| Day 43 | N/A | −55.5 ± 5.1 | −60.1 ± 8.8 | −54.3 ± 11.3 | 5.0 ± 38.0 | −29.0 ± 8.1 |
| Day 45 | N/A | 31.7 ± 28.8 | 63.0 ± 18.1 | 52.8 ± 29.0 | 50.5 ± 35.3 | 105.5 ± 34.7 |
| Day 50 | N/A | 103.7 ± 33.6 | 248.9 ± 98.5 | 357.1 ± 153.6 | 130.4 ± 68.1 | 219.1 ± 24.3 |
| Day 57 | 38.2 ± 42.5 | 36.4 ± 19.5 | −30.9 ± 12.4 | 7.5 ± 64.3 | 49.3 ± 45.1 | 47.4 ± 1.4 |
| Day 64 | 48.4 ± 62.8 | −24.8 ± 25.4 | −59.4 ± 4.2 | −60.7 ± 9.9 | −20.3 ± 10.6 | −28.1 ± 12.5 |

* p < 0.05 compared to Gr. 1

The absolute serum DKK1 concentrations as well as the percent change relative to predose (Table 17) were not significantly different between the controls and Ab-5-treated animals across all time points measured.

TABLE 17

Concentration of DKK1 in serum and % change from Day 1 predose of naïve, female cynomolgus monkeys for the duration of study

| | DKK1 (pg/ml) | | | DKK1 (% change from Day 1 predose) | |
|---|---|---|---|---|---|
| Time point of study | Gr 0 Controls n = 2 Mean ± SEM | Gr 1 Ab-5 n = 3 Mean ± SEM | Time point of study | Gr 0 Controls n = 2 Mean ± SEM | Gr 1 Ab-5 n = 3 Mean ± SEM |
| Day 1 predose | 1263.7 ± 366.9 | 1532.5 ± 140.8 | | | |
| Day 5 | N/A | 1088.9 ± 117.4 | Day 5 | N/A | −29.2 ± 1.8 |
| Day 7 | N/A | 1080.5 ± 136.9 | Day 7 | N/A | −29.9 ± 2.5 |
| Day 14 | 1077.5 ± 452.9 | 1239.8 ± 142.5 | Day 14 | 0.8 ± 25.5 | −19.3 ± 5.1 |
| Day 21 | N/A | 1288.1 ± 47.1 | Day 21 | N/A | −14.8 ± 6.8 |
| Day28 | 1199.3 ± 430.0 | 1438.3 ± 23.3 | Day28 | 17.8 ± 37.6 | −4.8 ± 7.3 |
| Day 36 | N/A | 1769.4 ± 32.3 | Day 36 | N/A | 17.6 ± 11.9 |
| Day 43 | N/A | 1895.6 ± 52.8 | Day 43 | N/A | 25.8 ± 12.5 |
| Day 45 | N/A | 1607.6 ± 99.8 | Day 45 | N/A | 7.7 ± 15.5 |
| Day 50 | N/A | 1523.5 ± 95.9 | Day 50 | N/A | 1.4 ± 13.1 |
| Day 57 | 1370.6 ± 427.0 | 1607.2 ± 91 | Day 57 | 39.5 ± 51.1 | 7.6 ± 15.6 |
| Day 64 | 1353.2 ± 440.0 | 1826.1 ± 146.9 | Day 64 | 36.4 ± 48.1 | 21.9 ± 18.4 |

In summary, DVD antibody 6.147-AbL-Ab23 treatment transiently lowered serum TRACP 5b (by percent change relative to predose) at day 5 (p<0.01) and day 7 (p<0.05) compared to Ab-5 treatment. C1CP (by percent change relative to predose) in the DVD antibody 6.147-AbL-Ab23 treated group was significantly reduced at day 14 (p<0.05) compared to the Ab-5-treated animals. Serum OC and BAP concentrations were not affected by DVD antibody 6.147-AbL-Ab23 treatment.

Heterodimeric antibody Ab-23-6.37.5 treatment also significantly decreased serum TRACP 5b (by percent change from predose) at day 5 and day 7 (p<0.05) compared to Ab-5 treatment alone. Animals treated with heterodimeric antibody Ab-23-6.37.5 showed significantly higher BAP (by percent change relative to predose) at day 5 (p<0.05) compared to the Ab-5-treated group but no significant difference was found in OC and C1CP levels.

There was no effect of treatment with heterodimeric antibody Ab-5-6.37.5 compared to Ab-5 treatment alone on serum TRAPSb, BAP or CICP at any timepoint evaluated. However, OC (by percent change relative to predose) in the heterodimeric antibody Ab-5-6.37.5 treated group was significantly increased at day 21 (p<0.05), day 28 (p<0.05), day 36 (p<0.01), day 43 (p<0.001) and day 45 (p<0.05) compared to the Ab-5 treated group.

Similarly TRAPCP 5b, BAP, and C1CP concentrations were not affected by heterodimeric antibody Ab-5-6.147 treatment vs. Ab-5 treatment alone. Serum OC concentrations in this group were significantly elevated compared to Ab-5 treated group at day 36 (p<0.05), day 43(p<0.05) and day 57 (p<0.01). Serum OC by percent change relative to pre-dose in the Ab-5-6.147 treated group was significantly increased at day 21, day 28, day 36 (p<0.05, respectively), day 43 (p<0.001), day 50, and day 57 (p<0.01, respectively) compared to the Ab-5 treated group.

Serum DKK1 concentrations were not significantly different between controls and Ab-5 treated animals across all timepoints evaluated.

These data provided in this Example demonstrate that heterodimeric antibodies directed against DKK1 and sclerostin have IgG-like pharmacokinetic properties that are similar to the parental Ab, Ab-5, and led to superior increases in specific bone formation markers following administration in cynomolgus monkeys. The effect of dual DKK1 and sclerostin inhibition observed in non-human primates and rodents highlights the therapeutic efficacy of heterodimeric antibodies for the treatment of bone disorders.

Example 18

Pharmacokinetic Properties of Heterodimeric Antibodies

The pharmacokinetic (PK) profiles of three heterodimeric antibodies (Ab23-6.37.5 v.1, Ab-5-6.37.5 v.1, and Ab-5-6.147 v.1) were characterized in the study.

Cynomolgus monkeys were divided into five treatment groups receiving 25 mg/kg of Ab-5 (Group 1), 34.4 mg/kg of DVD antibody 6.147-AbL-Ab23 (Group 2), or 25 mg/kg each of Ab-23-6.37.5.v.1 (Group 3), Ab-5-6.37.5.v.1 (Group 4) or Ab-5-6.147.v.1 (Group 5) by intravenous administration on Day 1 and 15 and subcutaneous administration on Day 43. Six hundred sixty two serum samples (over 64 days) were collected for PK analysis starting on study day 1, with samples also taken on study days 15 and 43.

The serum samples were analyzed using four different enzyme linked immunosorbent assays (ELISAs) (sclerostin/DKK1 Assay; sclerostin/Fc Assay; DKK1/sclerostin Assay; and FC/FC bridging ELISA Assay) as described above in Example 7. The serum samples from Group 1 for intact Ab-5 concentrations were analyzed using an ELISA with a pair of anti-idiotypic antibodies against Ab-5. The serum samples from Group 2 were analyzed using two different ELISAs: one to measure intact anti-DKK1 Mabs and one to measure total Mab concentrations. The serum samples for Groups 3, 4, and 5 were analyzed using three different ELISAs: one to measure intact anti-DKK1 Mabs, one to measure intact anti-sclerostin (SOST) Mabs, and one to measure total Mab concentration. Intact (DKK1) serum Mab concentration is determined by ELISA, where recombinant human DKK1 and anti-human Fc are used as capture and detection reagents, respectively. Intact (SOST) serum Mab concentration is determined by ELISA, where recombinant human SOST and anti-human Fc are used as capture and detection reagents. Additionally, total serum Mab concentration is determined by ELISA, where a pair of anti-human IgG Fc antibodies are used as capture and detection reagents.

Figure 13:
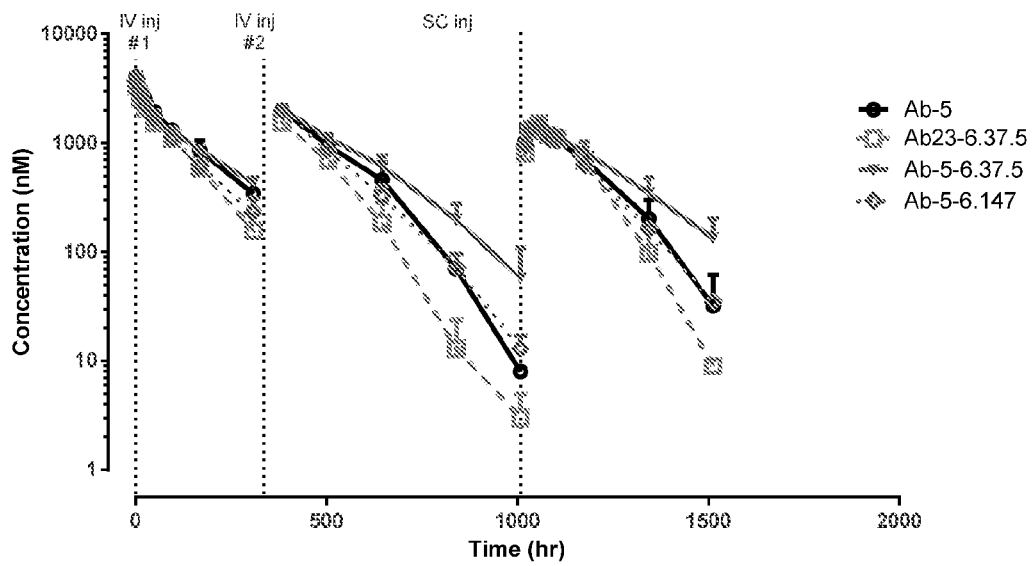
FIG. 13 is a graph depicting the pharmacokinetic profiles (concentration (nM) (y-axis) versus time (hour) (x-axis) of Ab-5, DVD antibody 6.147-AbL-Ab23, heterodimeric antibody Ab23-6.37.5.v.1, heterodimeric antibody Ab5-6.37.5.v.1 and heterodimeric antibody Ab5-6.147.v.1 following IV and SC injection.

The PK profiles of the three heterodimeric antibodies and positive controls are depicted in FIG. 13, and the PK parameters derived from the first IV dose data are summarized below in Table 18.

TABLE 18

PK parameter estimates for Ab23-6.37.5 v.1, Ab-5-6.37.5 v.1, and Ab-5-6.147 v.1 Hetero-Ig candidates derived from the 1st IV dose interval in cynomolgus monkeys.

| Compound (Intact) | Dose (mg/kg) | $T_{1/2}$ (Day) | C0_uM (uM) | AUC0_inf (Day*uM) | CL_pred (mL/h/kg) | F (%) |
|---|---|---|---|---|---|---|
| Ab-5 | 25 | 4.6 | 4.24 | 18.0 | 0.394 | 63 |
| DVD 6.147-AbL-Ab23 | 34.4 | 1.5 | 3.68 | 8.3 | 0.869 | 78 |
| Ab-23-6.37.5.v.1 | 25 | 3.2 | 3.49 | 12.6 | 0.553 | 83 |
| Ab-5-6.37.5.v.1 | 25 | 5.5 | 3.91 | 18.4 | 0.379 | 78 |
| Ab-5-6.147.v.1 | 25 | 3.5 | 4.0 | 13.8 | 0.527 | 78 |

Five monkeys in this study developed binding anti-drug antibodies (ADA) to the different Mabs which decreased drug exposure; these subjects were, therefore, excluded from the analysis. The terminal half-lives ($T_{1/2}$) of heterodimeric antibodies Ab-5-6.37.5 v.1, Ab-5-6.147 v.1 and Ab23-6.37.5 v.1 were estimated to be 5.5, 3.5 and 3.2 days, respectively. The exposure of Ab-5-6.37.5 v.1 was comparable to Ab-5 (AUC 0-Inf-18.4 Day*μM as compared to 18.0 Day*μM), while the other two hetero-Igs had approximately 25-30% lower exposure as compared to Ab-5. The bioavailability (F) of the three hetero-Igs was comparable, ranging from 78-83%.

Example 19

Additional In Vivo Experiments

A three week study was conducted in ten week old, intact mice to compare the bone anabolic activity of heterodimeric antibody (Ab-5-6.37.5.v.1) relative to each of parental Abs DKK1 Ab 6.37.5 and Ab-5, and to the combination of the two parental antibodies (IgGs) (n=6 per group). Given that the heterodimeric antibody is a monovalent inhibitor of sclerostin and DKK1, two doses of the heterodimeric antibody (i.e., 25 mg/kg and 12.5 mg/kg) were evaluated to measure the impact of valency on bioactivity relative to bivalent molecules used as controls.

The monotherapies (Ab-5 and DKK1 Ab 6.37.5 administered separately) and heterodimeric antibody therapy were each dosed subcutaneously twice a week at 12.5 mg/kg, and the combination of DKK1 Ab (6.37.5, 12.5 mg/kg) plus anti-sclerostin Ab (Ab-5, 12.5 mg/kg) was administered similarly in the control cohort. In addition, the heterodimeric antibody was dosed at 25 mg/kg to correct for valency relative to the bivalent controls used in the study. Bone mineral density was measured by DXA once a week.

Figure 14:
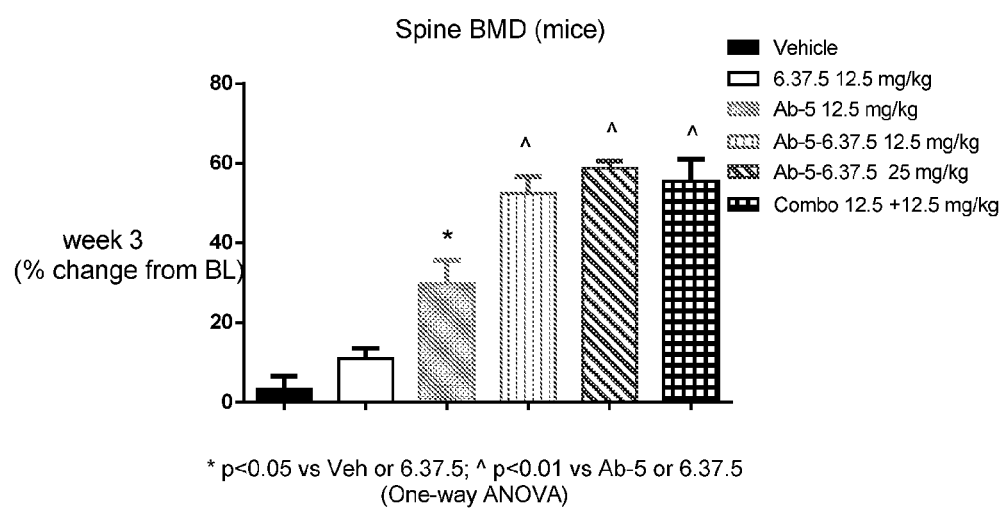
FIG. 14 is a graph depicting the percent change in bone mass compared to baseline in lumbar vertebtrae (y-axis) in mice receiving heterodimeric antibody (bars with vertical stripes and diagonal stripes), sclerostin antibody monotherapy (dotted bar), DKK1 antibody monotherapy (clear bar), or combined sclerostin antibody and DKK1 antibody (bar with horizontal stripe).

The results illustrated in FIG. 14 demonstrate that the increases in lumbar vertebrae bone mass mediated by heterodimeric antibody treatment were significantly superior to both monotherapies. The bone anabolic activity observed with the lower dose of heterodimeric antibody was not significantly different from that measured in mice treated with combination therapy. The higher dose of heterodimeric antibody was slightly superior to combination therapy though this difference was not significant. Similar increases in bone mass were observed in the femur (data not shown).

The simultaneous, dual DKK1 and sclerostin inhibition observed in rodents highlights the therapeutic efficacy of heterodimeric antibodies for the treatment of bone disorders compared to treatment with an anti-aclerostin antibody or DKK1 antibody alone.

SEQUENCE LISTING (1049 sequences)

SEQ ID NO: 1 - protein, 190 aa, Homo sapiens
QGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 2 - protein, 14 aa, Homo sapiens
DVSEYSCRELHFTR

SEQ ID NO: 3 - protein, 16 aa, Homo sapiens
SAKPVTELVCSGQCGP

SEQ ID NO: 4 - protein, 17 aa, Homo sapiens
WWRPSGPDFRCIPDRYR

SEQ ID NO: 5 - protein, 12 aa, Homo sapiens
LVASCKCKRLTR

SEQ ID NO: 6 - protein, 26 aa, Homo sapiens
CGPARLLPNAIGRGKWWRPSGPDFRC

SEQ ID NO: 7 - protein, 214 aa, Mus musculus
DVQMIQSPSSLSASLGDIVTMTCQASQGTSINLNWFQQKPGKAPKLLIYGSSNLEDGVPSRFSGSRYGTDFTLTISSLEDEDLATYFCLQHSYLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 8 - DNA, 645 bp, Mus musculus
gatgtccagatgattcagtctccatcctccctgtctgcatctttgggagacatagtcaccatgacttgccaggcaagtcagggcactagcattaatttaaactggtttcagcaaaaaccagggaaggctcctaagctcctgatctatggttcaagcaacttggaagatggggtcccatcaaggttcagtggcagtagatatgggacagatttcactctcaccatcagcagcctggaggatgaagatctggcaacttatttctgtctacaacatagttatctcccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 9 - protein, 236 aa, Mus musculus
MNTRAPAEFLGFLLLWFLGARCDVQMIQSPSSLSASLGDIVTMTCQASQGTSINLNWFQQKPGKAPKLLIYGSSNLEDGVPSRFSGSRYGTDFTLTISSLEDEDLATYFCLQHSYLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 10 - DNA, 711 bp, Mus musculus
atgaacacgagggcccctgctgagttccttgggttcctgttgctctggtttttaggtgccagatgtgatgtccagatgattcagtctccatcctccctgtctgcatctttgggagacatagtcaccatgacttgccaggcaagtcagggcactagcattaatttaaactggtttcagcaaaaaccagggaaggctcctaagctcctgatctatggttcaagcaacttggaagatggggtcccatcaaggttcagtggcagtagatatgggacagatttcactctcaccatcagcagcctggaggatgaagatctggcaacttatttctgtctacaacatagttatctcccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 11 - protein, 443 aa, Mus musculus
EVQLQQSGPELVTPGASVKISCKASGYTFTDHYMSWVKQSHGKSLEWIGDINPYSGETTYNQKFKGTATLTVDKSSSIAYMEIRGLTSEDSAVYYCARDDYDASPFAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSPAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 12 - DNA, 1332 bp, Mus musculus
gaggtccagctgcaacagtctggacctgaactggtgacgcctggggcttcagtgaagatatcttgtaaggcttctggatacacattcactgaccactacatgagctgggtgaagcagagtcatggaaaaagccttgagtggattggagatattaatccctattctggtgaaactacctacaaccagaagttcaagggcacggccacattgactgtagacaagtcttccagtatagcctacatggagatccgcggcctgacatctgaggactctgcagtctattactgtgcaagagatgattacgacgcctctccgtttgcttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtccagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 13 - protein, 462 aa, Mus musculus
MRCRWIFLFLLSGTAGVLSEVQLQQSGPELVTPGASVKISCKASGYTFTDHYMSWVKQSHGKSLEWIGDINPYSGETTYNQKFKGTATLTVDKSSSIAYMEIRGLTSEDSAVYYCARDDYDASPFAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSPAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 14 - DNA, 1389 bp, Mus musculus
atgagatgcaggtggatctttctctttctcctgtcaggaactgcaggtgtcctctctgaggtccagctgcaacagtctggacctgaactggtgacgcctggggcttcagtgaagatatcttgtaaggcttctggatacacattcactgaccactacatgagctgggtgaagcagagtcatggaaaaagccttgagtggattggagatattaatccctattctggtgaaactacctacaaccagaagttcaagggcacggccacattgactgtagacaagtcttccagtatagcctacatggagatccgcggcctgacatctgaggactctgcagtctattactgtgcaagagatgattacgacgcctctccgtttgcttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtccagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 15 - protein, 218 aa, Mus musculus
DIVLTQSPASLTVSLGLRATISCKASQSVDYDGDSYMNWYQQKPGQPPKLLIYAASNLESGIPARFSGNGSGTDFTLNIHPVEEEDAVTYYCQQSNEDPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 16 - DNA, 657 bp, Mus musculus
gacattgtgctgacccaatctccagcttctttgactgtgtctctaggcctgagggccaccatctcctgcaaggccagccaaagtgttgattatgatggtgatagttatatgaactggtaccagcagaaaccaggacagccacccaaactcctcatctatgctgcatccaatctagaatctgggatcccagccaggtttagtggcaatgggtctgggacagacttcaccctcaacatccatcctgtggaggaggaggatgctgtaacctattactgtcaacaaagtaatgaggatccgtggacgttcggtggaggcaccaagctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 17 - protein, 238 aa, Mus musculus
METDTILLWVLLLWVPGSTGDIVLTQSPASLTVSLGLRATISCKASQSVDYDGDSYMNWYQQKPGQPPKLLIYAASNLESGIPARFSGNGSGTDFTLNIHPVEEEDAVTYYCQQSNEDPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 18 - DNA, 717 bp, Mus musculus
atggagacagacacaatcctgctatgggtgctgctgctctgggttccaggctccactggtgacattgtgctgacccaatctccagcttctttgactgtgtctctaggcctgagggccaccatctcctgcaaggccagccaaagtgttgattatgatggtgatagttatatgaactggtaccagcagaaaccaggacagccacccaaactcctcatctatgctgcatccaatctagaatctgggatcccagccaggtttagtggcaatgggtctgggacagacttcaccctcaacatccatcctgtggaggaggaggatgctgtaacctattactgtcaacaaagtaatgaggatccgtggacgttcggtggaggcaccaagctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 19 - protein, 449 aa, Mus musculus
EVQLQQSGPELVKPGTSVKMSCKASGYTFTDCYMNWVKQSHGKSLEWIGDINPFNGGTTYNQKFKGKATLTVDKSSSTAYMQLNSLTSDDSAVYYCARSHYYFDGRVPWDAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 20 - DNA, 1350 bp, Mus musculus
gaggtccagctgcaacaatctggacctgagctggtgaagcctgggacttcagtgaagatgtcctgtaaggcttctggatacacattcactgactgctacatgaactgggtgaagcagagccatgggaagagccttgaatggattggagatattaatcctttcaacggtggtactacctacaaccagaagttcaagggcaaggccacattgactgtagacaaatcctccagcacagcctacatgcagctcaacagcctgacatctgacgactctgcagtctattactgtgcaagatcccattattacttcgatggtagagtcccttgggatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 21 - protein, 468 aa, Mus musculus
MGWNWIFLFLLSGTAGVYSEVQLQQSGPELVKPGTSVKMSCKASGYTFTDCYMNWVKQSHGKSLEWIGDINPFNGGTTYNQKFKGKATLTVDKSSSTAYMQLNSLTSDDSAVYYCARSHYYFDGRVPWDAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 22 - DNA, 1407 bp, Mus musculus
atgggatggaactggatctttctcttcctcttgtcaggaactgcaggtgtctactctgaggtccagctgcaacaatctggacctgagctggtgaagcctgggacttcagtgaagatgtcctgtaaggcttctggatacacattcactgactgctacatgaactgggtgaagcagagccatgggaagagccttgaatggattggagatattaatcctttcaacggtggtactacctacaaccagaagttcaagggcaaggccacattgactgtagacaaatcctccagcacagcctacatgcagctcaacagcctgacatctgacgactctgcagtctattactgtgcaagatcccattattacttcgatggtagagtcccttgggatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 23 - protein, 217 aa, Artificial Sequence
  Synthetic Polypeptide
  MISC_FEATURE: Rabbit-mouse chimera
AQVLTQTPASVSAAVGGTVTINCQSSQSVYDNNWLAWFQQKPGQPPKLLIYDASDLASGVPSRFSGSGSGTQFTLTISGVQCADAATYYCQGAYNDVIYAFGGGTEVVVKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 24 - DNA, 654 bp, Artificial Sequence
  Synthetic Polynucleotide
  misc_feature: Rabbit-mouse chimera
gcgcaagtgctgacccagactccagcctccgtgtctgcagctgtgggaggcacagtcaccatcaattgccagtccagtcagagtgtttatgataacaactggttagcctggtttcagcagaaaccagggcagcctcccaagctcctgatttatgatgcatccgatctggcatctggggtcccatcgcggttcagtggcagtggatctgggacacagttcactctcaccatcagcggcgtgcagtgtgccgatgctgccacttactactgtcaaggcgcttataatgatgttatttatgctttcggcggagggaccgaggtggtggtcaaacgtacggatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 25 - protein, 239 aa, Artificial Sequence
  Synthetic Polypeptide
  MISC_FEATURE: Rabbit-mouse chimera
MDTRAPTQLLGLLLLWLPGATFAQVLTQTPASVSAAVGGTVTINCQSSQSVYDNNWLAWFQQKPGQPPKLLIYDASDLASGVPSRFSGSGSGTQFTLTISGVQCADAATYYCQGAYNDVIYAFGGGTEVVVKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 26 - DNA, 720 bp, Artificial Sequence
  Synthetic Polynucleotide
  misc_feature: Rabbit-mouse chimera
atggacacgagggcccccactcagctgctggggctcctgctgctctggctcccaggtgccacatttgcgcaagtgctgacccagactccagcctccgtgtctgcagctgtgggaggcacagtcaccatcaattgccagtccagtcagagtgtttatgataacaactggttagcctggtttcagcagaaaccagggcagcctcccaagctcctgatttatgatgcatccgatctggcatctggggtcccatcgcggttcagtggcagtggatctgggacacagttcactctcaccatcagcggcgtgcagtgtgccgatgctgccacttactactgtcaaggcgcttataatgatgttatttatgctttcggcggagggaccgaggtggtggtcaaacgtacggatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 27 - protein, 433 aa, Artificial Sequence
  Synthetic polypeptide
  MISC_FEATURE: Humanized Antibody
QSLEESGGRLVTPGTPLTLTCTASGFSLSSYWMNWVRQAPGEGLEWIGTIDSGGRTDYASWAKGRFTISRTSTTMDLKMTSLTTGDTARYFCARNWNLWGQGTLVTVSSASTKGPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 28 - DNA, 1302 bp, Artificial Sequence
  Synthetic Polynucleotide
  misc_feature: Humanized Antibody
cagtcgctggaggagtccgggggtcgcctggtcacgcctgggacacccctgacactcacctgcacagcctctggattctccctcagtagttattggatgaactgggtccgccaggctccaggggaggggctggaatggatcggaaccattgattctggtggtaggacggactacgcgagctgggcaaaaggccgattcaccatctccagaacctcgactacgatggatctgaaaatgaccagtctgacgaccggggacacggcccgttatttctgtgccagaaattggaacttgtggggccaaggcaccctcgtcaccgtctcgagcgcttctacaaagggcccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 29 - protein, 452 aa, Artificial Sequence
  Synthetic Polypeptide
  MISC_FEATURE: Humanized Antibody
METGLRWLLLVAVLKGVHCQSLEESGGRLVTPGTPLTLTCTASGFSLSSYWMNWVRQAPGEGLEWIGTIDSGGRTDYASWAKGRFTISRTSTTMDLKMTSLTTGDTARYFCARNWNLWGQGTLVTVSSASTKGPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 30 - DNA, 1359 bp, Artificial Sequence
  Synthetic Polynucleotide
  misc_feature: Humanized Antibody
atggagactgggctgcgctggcttctcctggtcgctgtgctcaaaggtgtccactgtcagtcgctggaggagtccgggggtcgcctggtcacgcctgggacacccctgacactcacctgcacagcctctggattctccctcagtagttattggatgaactgggtccgccaggctccaggggaggggctggaatggatcggaaccattgattctggtggtaggacggactacgcgagctgggcaaaaggccgattcaccatctccagaacctcgactacgatggatctgaaaatgaccagtctgacgaccggggacacggcccgttatttctgtgccagaaattggaacttgtggggccaaggcaccctcgtcaccgtctcgagcgcttctacaaagggcccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 31 - protein, 213 aa, Mus musculus
QIVLTQSPTIVSASPGEKVTLICSASSSVSFVDWFQQKPGTSPKRWIYRTSNLGFGVPARFSGGGSGTSHSLTISRMEAEDAATYYCQQRSTYPPTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 32 - DNA, 642 bp, Mus musculus
caaattgttctcacccagtctccaacaatcgtgtctgcatctccaggggagaaggtcaccctaatctgcagtgccagttcaagtgtaagtttcgtggactggttccagcagaagccaggcacttctcccaaacgctggatttacagaacatccaacctgggttttggagtccctgctcgcttcagtggcggtggatctgggacctctcactctctcacaatcagccgaatggaggctgaagatgctgccacttattactgccagcaaaggagtacttacccacccacgttcggtgctgggaccaagctggaactgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 33 - protein, 235 aa, Mus musculus
MHFQVQIFSFLLISASVIVSRGQIVLTQSPTIVSASPGEKVTLICSASSSVSFVDWFQQKPGTSPKRWIYRTSNLGFGVPARFSGGGSGTSHSLTISRMEAEDAATYYCQQRSTYPPTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 34 - DNA, 708 bp, Mus musculus
atgcattttcaagtgcagattttcagcttcctgctaatcagtgcctcagtcatagtgtccagagggcaaattgttctcacccagtctccaacaatcgtgtctgcatctccaggggagaaggtcaccctaatctgcagtgccagttcaagtgtaagtttcgtggactggttccagcagaagccaggcacttctcccaaacgctggatttacagaacatccaacctgggttttggagtccctgctcgcttcagtggcggtggatctgggacctctcactctctcacaatcagccgaatggaggctgaagatgctgccacttattactgccagcaaaggagtacttacccacccacgttcggtgctgggaccaagctggaactgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 35 - protein, 449 aa, Mus musculus
QVTLKESGPGILQPSQTLSLTCSFSGFSLSTSGMGVGWIRHPSGKNLEWLAHIWWDDVKRYNPVLKSRLTISKDTSNSQVFLKIANVDTADTATYYCARIEDFDYDEEYYAMDYWGQGTSVIVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 36 - DNA, 1350 bp, Mus musculus
caggttactctgaaagagtctggccctgggatattgcagccctcccagaccctcagtctgacttgttctttctctgggttttcactgagcacttctggtatgggtgtaggctggattcgtcacccatcagggaagaatctggagtggctggcacacatttggtgggatgatgtcaagcgctataacccagtcctgaagagccgactgactatctccaaggatacctccaacagccaggtattcctcaagatcgccaatgtggacactgcagatactgccacatactactgtgctcgaatagaggactttgattacgacgaggagtattatgctatggactactggggtcaaggaacctcagtcatcgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 37 - protein, 468 aa, Mus musculus
MGRLTSSFLLLIVPAYVLSQVTLKESGPGILQPSQTLSLTCSFSGFSLSTSGMGVGWIRHPSGKNLEWLAHIWWDDVKRYNPVLKSRLTISKDTSNSQVFLKIANVDTADTATYYCARIEDFDYDEEYYAMDYWGQGTSVIVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 38 - DNA, 1407 bp, Mus musculus
atgggcaggcttacttcttcattcctgctactgattgtccctgcatatgtcctgtcccaggttactctgaaagagtctggccctgggatattgcagccctcccagaccctcagtctgacttgttctttctctgggttttcactgagcacttctggtatgggtgtaggctggattcgtcacccatcagggaagaatctggagtggctggcacacatttggtgggatgatgtcaagcgctataacccagtcctgaagagccgactgactatctccaaggatacctccaacagccaggtattcctcaagatcgccaatgtggacactgcagatactgccacatactactgtgctcgaatagaggactttgattacgacgaggagtattatgctatggactactggggtcaaggaacctcagtcatcgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 39 - protein, 5 aa, Mus musculus
DHYMS

SEQ ID NO: 40 - protein, 17 aa, Mus musculus
DINPYSGETTYNQKFKG

SEQ ID NO: 41 - protein, 10 aa, Mus musculus
DDYDASPFAY

SEQ ID NO: 42 - protein, 11 aa, Mus musculus
QASQGTSINLN

SEQ ID NO: 43 - protein, 7 aa, Mus musculus
GSSNLED

SEQ ID NO: 44 - protein, 9 aa, Mus musculus
LQHSYLPYT

SEQ ID NO: 45 - protein, 5 aa, Mus musculus
DCYMN

SEQ ID NO: 46 - protein, 17 aa, Mus musculus
DINPFNGGTTYNQKFKG

SEQ ID NO: 47 - protein, 16 aa, Mus musculus
SHYYFDGRVPWDAMDY

SEQ ID NO: 48 - protein, 15 aa, Mus musculus
KASQSVDYDGDSYMN

SEQ ID NO: 49 - protein, 7 aa, Mus musculus
AASNLES

SEQ ID NO: 50 - protein, 9 aa, Mus musculus
QQSNEDPWT

SEQ ID NO: 51 - protein, 5 aa, Artificial Sequence
  Synthetic Polypeptide
  MISC_FEATURE: Rabbit-mouse chimera
SYWMN

SEQ ID NO: 52 - protein, 16 aa, Artificial Sequence
  Synthetic Polypeptide
  MISC_FEATURE: Rabbit-mouse chimera
TIDSGGRTDYASWAKG

SEQ ID NO: 53 - protein, 4 aa, Artificial Sequence
  Synthetic Polypeptide
NWNL

SEQ ID NO: 54 - protein, 13 aa, Artificial Sequence
  Synthetic Polypeptide
  MISC_FEATURE: Rabbit-mouse chimera
QSSQSVYDNNWLA

SEQ ID NO: 55 - protein, 7 aa, Artificial Sequence
  Synthetic Polypeptide
  MISC_FEATURE: Rabbit-mouse chimera
DASDLAS

SEQ ID NO: 56 - protein, 10 aa, Artificial Sequence
  Synthetic Polypeptide
  MISC_FEATURE: Rabbit-mouse chimera
QGAYNDVIYA

SEQ ID NO: 57 - protein, 7 aa, Mus musculus
TSGMGVG

SEQ ID NO: 58 - protein, 16 aa, Mus musculus
HIWWDDVKRYNPVLKS

SEQ ID NO: 59 - protein, 14 aa, Mus musculus
EDFDYDEEYYAMDY

SEQ ID NO: 60 - protein, 10 aa, Mus musculus
SASSSVSFVD

SEQ ID NO: 61 - protein, 7 aa, Mus musculus
RTSNLGF

SEQ ID NO: 62 - protein, 9 aa, Mus musculus
QQRSTYPPT

SEQ ID NO: 63 - protein, 20 aa, Homo sapiens
CGPARLLPNAIGRGKWWRPS

SEQ ID NO: 64 - protein, 20 aa, Homo sapiens
GPARLLPNAIGRGKWWRPSG

SEQ ID NO: 65 - protein, 20 aa, Homo sapiens
PARLLPNAIGRGKWWRPSGP

SEQ ID NO: 66 - protein, 20 aa, Homo sapiens
ARLLPNAIGRGKWWRPSGPD

SEQ ID NO: 67 - protein, 20 aa, Homo sapiens
RLLPNAIGRGKWWRPSGPDF

SEQ ID NO: 68 - protein, 20 aa, Homo sapiens
LLPNAIGRGKWWRPSGPDFR

SEQ ID NO: 69 - protein, 20 aa, Homo sapiens
LPNAIGRGKWWRPSGPDFRC

SEQ ID NO: 70 - protein, 14 aa, Homo sapiens
SAKPVTELVCSGQC

SEQ ID NO: 71 - protein, 7 aa, Homo sapiens
LVASCKC

SEQ ID NO: 72 - protein, 8 aa, Homo sapiens
CRELHFTR

SEQ ID NO: 73 - protein, 7 aa, Homo sapiens
CIPDRYR

SEQ ID NO: 74 - DNA, 399 bp, Artificial Sequence
  Synthetic Polynucleotide
  misc_feature: Humanized Antibody Sequence
atggacacgagggcccccactcagctgctggggctcctgctgctctggctcccaggtgccacatttgctcaagttctgacccagagtccaagcagtctctccgccagcgtaggcgatcgtgtgactattacctgtcaatctagtcagagcgtgtatgataacaattggctggcgtggtaccagcaaaaaccgggcaaagccccgaagctgctcatctatgacgcgtccgatctggctagcggtgtgccaagccgtttcagtggcagtggcagcggtactgactttaccctcacaatttcgtctctccagccggaagatttcgccacttactattgtcaaggtgcttacaacgatgtgatttatgccttcggtcagggcactaaagtagaaatcaaacgt

SEQ ID NO: 75 - protein, 133 aa, Artificial Sequence
  Synthetic Polypeptide
  MISC_FEATURE: Humanized Antibody Sequence
MDTRAPTQLLGLLLLWLPGATFAQVLTQSPSSLSASVGDRVTITCQSSQSVYDNNWLAWYQQKPGKAPKLLIYDASDLASGVPSRFSGSGSGTDFTLTISSLQPEDFATYYCQGAYNDVIYAFGQGTKVEIKR

SEQ ID NO: 76 - DNA, 393 bp, Artificial Sequence
  Synthetic Polynucleotide
  misc_feature: Humanized Antibody Sequence
atggagactgggctgcgctggcttctcctggtcgctgtgctcaaaggtgtccactgtgaggtgcagctgttggagtctggaggcgggcttgtccagcctggagggagcctgcgtctctcttgtgcagcaagcggcttcagcttatcctcttactggatgaattgggtgcggcaggcacctgggaagggcctggagtgggtgggcaccattgattccggaggccgtacagactacgcgtcttgggcaaagggccgtttcaccatttcccgcgacaactccaaaaataccatgtacctccagatgaactctctccgcgcagaggacacagcacgttattactgtgcacgcaactggaatctgtggggtcaaggtactcttgtaacagtctcgagc

SEQ ID NO: 77 - protein, 131 aa, Artificial Sequence
  Synthetic Polypeptide
  MISC_FEATURE: Humanized Antibody Sequence
METGLRWLLLVAVLKGVHCEVQLLESGGGLVQPGGSLRLSCAASGFSLSSYWMNWVRQAPGKGLEWVGTIDSGGRTDYASWAKGRFTISRDNSKNTMYLQMNSLRAEDTARYYCARNWNLWGQGTLVTVSS

SEQ ID NO: 78 - protein, 11 aa, Mus musculus
RASQDISNYLN

SEQ ID NO: 79 - protein, 7 aa, Mus musculus
YTSRLLS

SEQ ID NO: 80 - protein, 9 aa, Mus musculus
QQGDTLPYT

SEQ ID NO: 81 - protein, 11 aa, Mus musculus
RASQDISNYLN

SEQ ID NO: 82 - protein, 24 aa, Rattus norvegicus
QGWQAFKNDATEIIPGLREYPEPP

SEQ ID NO: 83 - protein, 20 aa, Rattus norvegicus
TEIIPGLREYPEPPQELENN

SEQ ID NO: 84 - protein, 20 aa, Rattus norvegicus
PEPPQELENNQTMNRAENGG

SEQ ID NO: 85 - protein, 20 aa, Rattus norvegicus
ENGGRPPHHPYDTKDVSEYS

SEQ ID NO: 86 - protein, 14 aa, Rattus norvegicus
CRELHYTRFVTDGP

SEQ ID NO: 87 - protein, 25 aa, Rattus norvegicus
CRELHYTRFVTDGPSRSAKPVTELV

SEQ ID NO: 88 - protein, 23 aa, Rattus norvegicus
CRSAKPVTELVSSGQSGPRARLL

SEQ ID NO: 89 - protein, 25 aa, Rattus norvegicus
CGPARLLPNAIGRVKWWRPNGPDFR

SEQ ID NO: 90 - protein, 20 aa, Rattus norvegicus
RAQRVQLLCPGGAAPRSRKV

SEQ ID NO: 91 - protein, 16 aa, Rattus norvegicus
PGGAAPRSRKVRLVAS

SEQ ID NO: 92 - protein, 23 aa, Rattus norvegicus
KRLTRFHNQSELKDFGPETARPQ

SEQ ID NO: 93 - protein, 16 aa, Rattus norvegicus
IPDRYAQRVQLLSPGG

SEQ ID NO: 94 - protein, 24 aa, Rattus norvegicus
SELKDFGPETARPQKGRKPRPRAR

SEQ ID NO: 95 - protein, 23 aa, Rattus norvegicus
KGRKPRPRARGAKANQAELENAY

SEQ ID NO: 96 - protein, 18 aa, Rattus norvegicus
PNAIGRVKWWRPNGPDFR

SEQ ID NO: 97 - protein, 22 aa, Rattus norvegicus
KWWRPNGPDFRCIPDRYRAQRV

SEQ ID NO: 98 - protein, 213 aa, Rattus norvegicus
MQLSLAPCLACLLVHAAFVAVESQGWQAFKNDATEIIPGLREYPEPPQELENNQTMNRAENGGRPPHHPYDTKDVSEYSCRELHYTRFVTDGPCRSAKPVTELVCSGQCGPARLLPNAIGRVKWWRPNGPDFRCIPDRYRAQRVQLLCPGGAAPRSRKVRLVASCKCKRLTRFHNQSELKDFGPETARPQKGRKPRPRARGAKANQAELENAY

SEQ ID NO: 99 - protein, 7 aa, Mus musculus
YTSRLHS

SEQ ID NO: 100 - protein, 9 aa, Mus musculus
QQGDTLPYT

SEQ ID NO: 101 - protein, 11 aa, Mus musculus
RASQVITNYLY

SEQ ID NO: 102 - protein, 7 aa, Mus musculus
YTSRLHS

SEQ ID NO: 103 - protein, 9 aa, Mus musculus
QQGDTLPYT

SEQ ID NO: 104 - protein, 11 aa, Mus musculus
RASQDISNYLN

SEQ ID NO: 105 - protein, 7 aa, Mus musculus
YTSRLLS

SEQ ID NO: 106 - protein, 9 aa, Mus musculus
QQGDTLPYT

SEQ ID NO: 107 - protein, 11 aa, Mus musculus
RASQDISNYLN

SEQ ID NO: 108 - protein, 7 aa, Mus musculus
YTSRLFS

SEQ ID NO: 109 - protein, 9 aa, Mus musculus
QQGDTLPYT

SEQ ID NO: 110 - protein, 11 aa, Mus musculus
RASQDISNYLN

SEQ ID NO: 111 - protein, 7 aa, Mus musculus
YTSRLLS

SEQ ID NO: 112 - protein, 9 aa, Mus musculus
QQGDTLPYT

SEQ ID NO: 113 - protein, 11 aa, Mus musculus
RASQDISNYLN

SEQ ID NO: 114 - protein, 7 aa, Mus musculus
YTSTLQS

SEQ ID NO: 115 - protein, 9 aa, Mus musculus
QQGDTLPYT

SEQ ID NO: 116 - protein, 12 aa, Mus musculus
SVSSSISSSNLH

SEQ ID NO: 117 - protein, 213 aa, Mus musculus
QIVLSQSPAILSTSPGEKVTMTCRASSSVYYMHWYQQKPGSSPKPWIYATSNLASGVPVRFSGSGSGTSYSLTITRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 118 - DNA, 642 bp, Mus musculus
caaattgttctctcccagtctccagcaatcctgtctacatctccaggggagaaggtcacaatgacttgcagggccagctcaagtgtatattacatgcactggtaccagcagaagccaggatcctcccccaaaccctggatttatgccacatccaacctggcttctggagtccctgttcgcttcagtggcagtgggtctgggacctcttactctctcacaatcaccagagtggaggctgaagatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 119 - protein, 235 aa, Mus musculus
MDFQVQIFSFLLISASVIMSRGQIVLSQSPAILSTSPGEKVTMTCRASSSVYYMHWYQQKPGSSPKPWIYATSNLASGVPVRFSGSGSGTSYSLTITRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 120 - DNA, 708 bp, Mus musculus
atggattttcaagtgcagattttcagcttcctgctaatcagtgcttcagtcattatgtccaggggacaaattgttctctcccagtctccagcaatcctgtctacatctccaggggagaaggtcacaatgacttgcagggccagctcaagtgtatattacatgcactggtaccagcagaagccaggatcctcccccaaaccctggatttatgccacatccaacctggcttctggagtccctgttcgcttcagtggcagtgggtctgggacctcttactctctcacaatcaccagagtggaggctgaagatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 121 - protein, 445 aa, Mus musculus
EVQVQQSGPELVKPGASVKLSCTASGFNIKDYFIHWVKQRPEQGLEWIGRLDPEDGESDYAPKFQDKAIMTADTSSNTAYLQLRSLTSEDTAIYYCEREDYDGTYTFFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 122 - DNA, 1338 bp, Mus musculus
gaggttcaggtgcagcagtctgggccagaacttgtgaagccaggggcctcagtcaagttgtcctgcacagcttctggcttcaacattaaagactactttatacactgggtgaagcagaggcctgaacagggcctggagtggattggaaggcttgatcctgaggatggtgaaagtgattatgccccgaagttccaggacaaggccattatgacagcagacacatcatccaacacagcctatcttcagctcagaagcctgacatctgaggacactgccatctattattgtgagagagaggactacgatggtacctacaccttttttccttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 123 - protein, 464 aa, Mus musculus
MKCSWVIFFLMAVVTGVNSEVQVQQSGPELVKPGASVKLSCTASGFNIKDYFIHWVKQRPEQGLEWIGRLDPEDGESDYAPKFQDKAIMTADTSSNTAYLQLRSLTSEDTAIYYCEREDYDGTYTFFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 124 - DNA, 1395 bp, Mus musculus
atgaaatgcagctgggtcatcttcttcctgatggcagtggttacaggggtcaattcagaggttcaggtgcagcagtctgggccagaacttgtgaagccaggggcctcagtcaagttgtcctgcacagcttctggcttcaacattaaagactactttatacactgggtgaagcagaggcctgaacagggcctggagtggattggaaggcttgatcctgaggatggtgaaagtgattatgccccgaagttccaggacaaggccattatgacagcagacacatcatccaacacagcctatcttcagctcagaagcctgacatctgaggacactgccatctattattgtgagagagaggactacgatggtacctacaccttttttccttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 125 - protein, 215 aa, Mus musculus
EIVLTQSPALMAASPGEKVTITCSVSSTISSNHLHWFQQKSDTSPKPWIYGTSNLASGVPVRFSGSGSGTSYSLTISSMEAEDAATYYCQQWSSYPLTFGAGTKLELRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 126 - DNA, 648 bp, Mus musculus
gaaattgtgctcacccagtctccagcactcatggctgcatctccgggggagaaggtcaccatcacctgcagtgtcagttcaactataagttccaaccacttgcactggttccagcagaagtcagacacctcccccaaaccctggatttatggcacatccaacctggcttctggagtccctgttcgcttcagtggcagtggatctgggacctcttattctctcacaatcagcagcatggaggctgaggatgctgccacttattactgtcaacagtggagtagttacccactcacgttcggcgctgggaccaagctggagctgagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 127 - protein, 237 aa, Mus musculus
MDFHVQIFSFMLISVTVILSSGEIVLTQSPALMAASPGEKVTITCSVSSTISSNHLHWFQQKSDTSPKPWIYGTSNLASGVPVRFSGSGSGTSYSLTISSMEAEDAATYYCQQWSSYPLTFGAGTKLELRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 128 - DNA, 714 bp, Mus musculus
atggattttcatgtgcagattttcagcttcatgctaatcagtgtcacagtcattttgtccagtggagaaattgtgctcacccagtctccagcactcatggctgcatctccgggggagaaggtcaccatcacctgcagtgtcagttcaactataagttccaaccacttgcactggttccagcagaagtcagacacctcccccaaaccctggatttatggcacatccaacctggcttctggagtccctgttcgcttcagtggcagtggatctgggacctcttattctctcacaatcagcagcatggaggctgaggatgctgccacttattactgtcaacagtggagtagttacccactcacgttcggcgctgggaccaagctggagctgagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 129 - protein, 449 aa, Mus musculus
EVQLQQSGAELVRPGALVKLSCTASDFNIKDFYLHWMRQRPEQGLDWIGRIDPENGDTLYDPKFQDKATLTTDTSSNTAYLQLSGLTSETTAVYYCSREADYFHDGTSYWYFDVWGAGTTITVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 130 - DNA, 1350 bp, Mus musculus
gaggttcagctgcagcagtctggggctgaacttgtgaggccaggggccttagtcaagttgtcctgcacagcttctgacttcaacattaaagacttctatctacactggatgaggcagcggcctgaacagggcctggactggattggaaggattgatcctgagaatggtgatactttatatgacccgaagttccaggacaaggccactcttacaacagacacatcctccaacacagcctacctgcagctcagcggcctgacatctgagaccactgccgtctattactgttctagagaggcggattatttccacgatggtacctcctactggtacttcgatgtctggggcgcagggaccacaatcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 131 - protein, 468 aa, Mus musculus
MKCSWVIFFLMAVVTGVNSEVQLQQSGAELVRPGALVKLSCTASDFNIKDFYLHWMRQRPEQGLDWIGRIDPENGDTLYDPKFQDKATLTTDTSSNTAYLQLSGLTSETTAVYYCSREADYFHDGTSYWYFDVWGAGTTITVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 132 - DNA, 1407 bp, Mus musculus
atgaaatgcagctgggtcatcttcttcctgatggcagtggttacaggggtcaattcagaggttcagctgcagcagtctggggctgaacttgtgaggccaggggccttagtcaagttgtcctgcacagcttctgacttcaacattaaagacttctatctacactggatgaggcagcggcctgaacagggcctggactggattggaaggattgatcctgagaatggtgatactttatatgacccgaagttccaggacaaggccactcttacaacagacacatcctccaacacagcctacctgcagctcagcggcctgacatctgagaccactgccgtctattactgttctagagaggcggattatttccacgatggtacctcctactggtacttcgatgtctggggcgcagggaccacaatcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 133 - protein, 214 aa, Mus musculus
DIQMTQITSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 134 - DNA, 645 bp, Mus musculus
gatatccagatgacacagattacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 135 - protein, 234 aa, Mus musculus
MMSSAQFLGLLLLCFQGTRCDIQMTQITSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 136 - DNA, 705 bp, Mus musculus
atgatgtcctctgctcagttccttggtctcctgttgctctgttttcaaggtaccagatgtgatatccagatgacacagattacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 137 - protein, 447 aa, Mus musculus
EVQLQQSGPELMKPGASVKMSCKASGYTFTDYNMHWVKQNQGKTLEWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 138 - DNA, 1344 bp, Mus musculus
gaggtccaactgcaacagtctggacctgaactaatgaagcctggggcttcagtgaagatgtcctgcaaggcttctggatatacattcactgactacaacatgcactgggtgaagcagaaccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 139 - protein, 466 aa, Mus musculus
MGWSWTFLFLLSGTAGVLSEVQLQQSGPELMKPGASVKMSCKASGYTFTDYNMHWVKQNQGKTLEWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 140 - DNA, 1401 bp, Mus musculus
atgggatggagctggacctttctcttcctcctgtcaggaactgcaggtgtcctctctgaggtccaactgcaacagtctggacctgaactaatgaagcctggggcttcagtgaagatgtcctgcaaggcttctggatatacattcactgactacaacatgcactgggtgaagcagaaccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 141 - protein, 214 aa, Artificial Sequence
  Synthetic Polypeptide
  MISC_FEATURE: Humanized Antibody Sequence
DIQMTQSPSSLSASVGDRVTITCRASQDISNYLNWYQQKPGKAPKLLIYYTSRLLSGVPSRFSGSGSGTDFTLTISSLQPEDFATYYCQQGDTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 142 - DNA, 642 bp, Artificial Sequence
  Synthetic Polynucleotide
  misc_feature: Humanized Antibody Sequence
gacatccagatgacccagtctccatcctccctctccgcatccgtaggcgaccgcgtaaccataacatgtagagcatctcaagatatttccaactatttgaattggtaccaacaaaaacccggcaaagcacctaaactcctcatttactatacatcaagactcctctccggcgttccatcacgattctcaggctccggctccggcacagatttcacactcactatttcctccctccaaccagaagattttgcaacctattactgtcaacaaggcgatacactcccatacacattcggcggcggcacaaaagttgaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 143 - protein, 236 aa, Artificial Sequence
  Synthetic Polypeptide
  MISC_FEATURE: Humanized Antibody Sequence
MDMRVPAQLLGLLLLWLRGARCDIQMTQSPSSLSASVGDRVTITCRASQDISNYLNWYQQKPGKAPKLLIYYTSRLLSGVPSRFSGSGSGTDFTLTISSLQPEDFATYYCQQGDTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 144 - DNA, 708 bp, Artificial Sequence
  Synthetic Polynucleotide
  misc_feature: Humanized Antibody Sequence
atggacatgagggtccccgctcagctcctggggctcctgctactctggctccgaggtgccagatgtgacatccagatgacccagtctccatcctccctctccgcatccgtaggcgaccgcgtaaccataacatgtagagcatctcaagatatttccaactatttgaattggtaccaacaaaaacccggcaaagcacctaaactcctcatttactatacatcaagactcctctccggcgttccatcacgattctcaggctccggctccggcacagatttcacactcactatttcctccctccaaccagaagattttgcaacctattactgtcaacaaggcgatacactcccatacacattcggcggcggcacaaaagttgaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 145 - protein, 449 aa, Artificial Sequence
  Synthetic Polypeptide
  MISC_FEATURE: Humanized Antibody Sequence
EVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 146 - DNA, 1347 bp, Artificial Sequence
  Synthetic Polynucleotide
  misc_feature: Humanized Antibody Sequence
gaggtgcagctggtgcagagcggcgccgaggtaaaaaaaccaggagcaagcgttaaagtttcttgtaaagcaagcggatatacatttacagattacaacatgcattgggtaagacaagcgccaggacaaggattggaatggatgggcgaaattaaccctaatagtggaggagcaggctacaatcaaaaattcaaagggagagttacaatgacaacagacacaagcacttcaacagcatatatggaactgcgatcacttagaagcgacgatacagctgtatactattgcgcacgacttgggtatgatgatatatatgatgactggtatttcgatgtttggggccagggaacaacagttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 147 - protein, 468 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 148 - DNA, 1404 bp, Mus musculus
atggactggacctggaggatcctcttcttggtggcagcagccacaggagcccactccgaggtgcagctggtgcagagcggcgccgaggtaaaaaaaccaggagcaagcgttaaagtttcttgtaaagcaagcggatatacatttacagattacaacatgcattgggtaagacaagcgccaggacaaggattggaatggatgggcgaaattaaccctaatagtggaggagcaggctacaatcaaaaattcaaagggagagttacaatgacaacagacacaagcacttcaacagcatatatggaactgcgatcacttagaagcgacgatacagctgtatactattgcgcacgacttgggtatgatgatatatatgatgactggtatttcgatgtttggggccagggaacaacagttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 149 - protein, 214 aa, Mus musculus
DIQMTQTTSSLSASLGDRVTISCRASQDISNYLNWFQQKPDGTLKLLIFYTSRLHSGVPSRFSGSGSGTDYSLTISNLEQEDIATYFCQQGDTLPYTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 150 - DNA, 645 bp, Mus musculus
gatatccagatgacacagactacatcctccctgtctgcctctctgggagacagagtcaccatcagttgcagggcaagtcaggacattagcaattatttaaactggtttcagcagaaaccagatggaactcttaaactcctgatcttctacacatcaagattacactcaggagttccatcaaggttcagtggcagtgggtctggaacagattattctctcaccattagcaacctggagcaagaagatattgccacttacttttgccaacagggtgatacgcttccgtacacgttcgggggggggaccaagctggaaataagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 151 - protein, 234 aa, Mus musculus
MMSSAQFLGLLLLCFQGTRCDIQMTQTTSSLSASLGDRVTISCRASQDISNYLNWFQQKPDGTLKLLIFYTSRLHSGVPSRFSGSGSGTDYSLTISNLEQEDIATYFCQQGDTLPYTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 152 - DNA, 705 bp, Mus musculus
atgatgtcctctgctcagttccttggtctcctgttgctctgttttcaaggtaccagatgtgatatccagatgacacagactacatcctccctgtctgcctctctgggagacagagtcaccatcagttgcagggcaagtcaggacattagcaattatttaaactggtttcagcagaaaccagatggaactcttaaactcctgatcttctacacatcaagattacactcaggagttccatcaaggttcagtggcagtgggtctggaacagattattctctcaccattagcaacctggagcaagaagatattgccacttacttttgccaacagggtgatacgcttccgtacacgttcgggggggggaccaagctggaaataagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 153 - protein, 447 aa, Mus musculus
EVQLQQSGPELMKPGASVKMSCKASGYTFTDYNMHWVKQNQGKSLEWIGEINPNSGGSGYNQKFKGKATLTVDKSSSTAYMELRSLTSEDSAVYYCARLVYDGSYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 154 - DNA, 1344 bp, Mus musculus
gaggtccagctgcaacagtctggacctgaactaatgaagcctggggcttcagtgaagatgtcctgcaaggcttctggatacacattcactgactacaacatgcactgggtgaaacagaaccaaggaaagagcctagagtggataggagaaattaatcctaacagtggtggtagtggctacaaccaaaagttcaaaggcaaggccacattgactgtagacaagtcttccagcacagcctacatggagctccgcagcctgacatctgaggactctgcagtctattactgtgcaagattggtctacgatggcagctacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 155 - protein, 466 aa, Mus musculus
MGWSWTFLFLLSGTAGVLSEVQLQQSGPELMKPGASVKMSCKASGYTFTDYNMHWVKQNQGKSLEWIGEINPNSGGSGYNQKFKGKATLTVDKSSSTAYMELRSLTSEDSAVYYCARLVYDGSYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 156 - DNA, 1401 bp, Mus musculus
atgggatggagctggacctttctcttcctcctgtcaggaactgcaggtgtcctctctgaggtccagctgcaacagtctggacctgaactaatgaagcctggggcttcagtgaagatgtcctgcaaggcttctggatacacattcactgactacaacatgcactgggtgaaacagaaccaaggaaagagcctagagtggataggagaaattaatcctaacagtggtggtagtggctacaaccaaaagttcaaaggcaaggccacattgactgtagacaagtcttccagcacagcctacatggagctccgcagcctgacatctgaggactctgcagtctattactgtgcaagattggtctacgatggcagctacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 157 - protein, 214 aa, Mus musculus
DIQMTQTTSSLSASLGDRVTICCRASQVITNYLYWYQQKPDGTFKLLIYYTSRLHSGVPSRFSGSGSGTDYSLTISNLEQEDIATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 158 - DNA, 642 bp, Mus musculus
gatatccagatgacacagactacatcctccctgtctgcctctctgggagacagagtcaccatctgttgcagggcaagtcaggtcattaccaattatttatactggtatcagcagaaaccagatggaacttttaaactcctgatctactacacatcaagattacactcaggagtcccatcaaggttcagtggcagtgggtctggaacagattattctctcaccattagcaacctggaacaggaagatattgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 159 - protein, 234 aa, Mus musculus
MMSSAQFLGLLLLCFQGTRCDIQMTQTTSSLSASLGDRVTICCRASQVITNYLYWYQQKPDGTFKLLIYYTSRLHSGVPSRFSGSGSGTDYSLTISNLEQEDIATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 160 - DNA, 702 bp, Mus musculus
atgatgtcctctgctcagttccttggtctcctgttgctctgttttcaaggtaccagatgtgatatccagatgacacagactacatcctccctgtctgcctctctgggagacagagtcaccatctgttgcagggcaagtcaggtcattaccaattatttatactggtatcagcagaaaccagatggaacttttaaactcctgatctactacacatcaagattacactcaggagtcccatcaaggttcagtggcagtgggtctggaacagattattctctcaccattagcaacctggaacaggaagatattgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 161 - protein, 447 aa, Mus musculus
EVQLQQSGPELMKPGASVKMSCKASGYTFTDYNMHWMKQNQGKSLEWIGEINPNSGGAGYNQQFKGKATLTVDKSSRTAYMELRSLTSEDSAVYYCARLGYVGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 162 - DNA, 1341 bp, Mus musculus
gaggtccagctgcaacagtctggacctgaactaatgaagcctggggcttcagtgaagatgtcctgcaaggcttctggatacacattcactgactacaacatgcactggatgaagcagaaccaaggaaagagcctagaatggataggagaaattaatcctaacagtggtggtgctggctacaaccagcagttcaaaggcaaggccacattgactgtagacaagtcctccaggacagcctacatggagctccgcagcctgacatctgaggactctgcagtctattactgtgcaagattgggctacgttggtaattacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 163 - protein, 466 aa, Mus musculus
MGWSWTFLFLLSGTAGVLSEVQLQQSGPELMKPGASVKMSCKASGYTFTDYNMHWMKQNQGKSLEWIGEINPNSGGAGYNQQFKGKATLTVDKSSRTAYMELRSLTSEDSAVYYCARLGYVGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 164 - DNA, 1398 bp, Mus musculus
atgggatggagctggacctttctcttcctcctgtcaggaactgcaggtgtcctctctgaggtccagctgcaacagtctggacctgaactaatgaagcctggggcttcagtgaagatgtcctgcaaggcttctggatacacattcactgactacaacatgcactggatgaagcagaaccaaggaaagagcctagaatggataggagaaattaatcctaacagtggtggtgctggctacaaccagcagttcaaaggcaaggccacattgactgtagacaagtcctccaggacagcctacatggagctccgcagcctgacatctgaggactctgcagtctattactgtgcaagattgggctacgttggtaattacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 165 - protein, 214 aa, Mus musculus
DIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 166 - DNA, 645 bp, Mus musculus
gatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 167 - protein, 234 aa, Mus musculus
MMSSAQFLGLLLLCFQGTRCDIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 168 - DNA, 705 bp, Mus musculus
atgatgtcctctgctcagttccttggtctcctgttgctctgttttcaaggtaccagatgtgatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 169 - protein, 447 aa, Mus musculus
EVQLQQSGPELMKPGASVKMSCKASGYTFTDYNMHWVKQNQGKTLDWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 170 - DNA, 1344 bp, Mus musculus
gaggtccaactgcaacagtctggacctgaactaatgaagcctggggcttcagtgaagatgtcctgcaaggcttctggatatacattcactgactacaacatgcactgggtgaagcagaaccaaggaaagaccctagactggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 171 - protein, 466 aa, Mus musculus
MGWSWTFLFLLSGTAGVLSEVQLQQSGPELMKPGASVKMSCKASGYTFTDYNMHWVKQNQGKTLDWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 172 - DNA, 1401 bp, Mus musculus
atgggatggagctggacctttctcttcctcctgtcaggaactgcaggtgtcctctctgaggtccaactgcaacagtctggacctgaactaatgaagcctggggcttcagtgaagatgtcctgcaaggcttctggatatacattcactgactacaacatgcactgggtgaagcagaaccaaggaaagaccctagactggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 173 - protein, 214 aa, Mus musculus
DIQMTQITSSLSASLGDRVSISCRASQDISNYLNWYQQKPDGTFKLLIFYTSRLFSGVPSRFSGSGSGTDYSLTIYNLEQEDFATYFCQQGDTLPYTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 174 - DNA, 642 bp, Mus musculus
gatatccagatgacacagattacatcctccctgtctgcctctctgggagacagggtctccatcagttgcagggcaagtcaagacattagcaattatttaaattggtatcagcagaaaccagatggaacttttaaactccttatcttctacacatcaagattattttcaggagtcccatcaaggttcagtggcagtgggtctggaacagattattctctcaccatttacaacctggagcaagaagattttgccacttacttttgccaacagggagatacgcttccgtacactttcggaggggggaccaaggtggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 175 - protein, 234 aa, Mus musculus
MMSSAQFLGLLLLCFQGTRCDIQMTQITSSLSASLGDRVSISCRASQDISNYLNWYQQKPDGTFKLLIFYTSRLFSGVPSRFSGSGSGTDYSLTIYNLEQEDFATYFCQQGDTLPYTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 176 - DNA, 702 bp, Mus musculus
atgatgtcctctgctcagttccttggtctcctgttgctctgttttcaaggtaccagatgtgatatccagatgacacagattacatcctccctgtctgcctctctgggagacagggtctccatcagttgcagggcaagtcaagacattagcaattatttaaattggtatcagcagaaaccagatggaacttttaaactccttatcttctacacatcaagattattttcaggagtcccatcaaggttcagtggcagtgggtctggaacagattattctctcaccatttacaacctggagcaagaagattttgccacttacttttgccaacagggagatacgcttccgtacactttcggaggggggaccaaggtggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 177 - protein, 450 aa, Mus musculus
EVQLQQSGPELMKPGTSVKMSCKASGYTFTDYNMHWVKQTQGKTLEWIGEINPNSGGAGYNQKFKGKATLTVDKSSTTAYMELRSLTSEDSAVYYCAKLGYDDIYDDWYFDVWGAGTTVTVSSAKTTAPSVYPLAPVCGDTTGSSVTLGCLVKGYFPEPVTLTWNSGSLSSDVHTFPALLQSGLYTLSSSVTVTTWPSQTITCNVAHPASSTKVDKKIEPRGSPTHKPCPPCPAPNLLGGPSVFIFPPKIKDVLMISLSPMVTCVVVDVSEDDPDVHVSWFVNNVEVHTAQTQTHREDYNSTIRVVSALPIQHQDWMSGKEFKCKVNNKALPAPIERTISKPKGPVRAPQVYVLPPPEEEMTKKQVTLTCMITDFMPEDIYVEWTNNGQTELNYKNTEPVLDSDGSYFMYSKLRVEKKNWVERNSYSCSVVHEGLHNHHTTKSFSRTPGK

SEQ ID NO: 178 - DNA, 1350 bp, Mus musculus
gaggtccaactgcaacagtctggacctgaactaatgaagcctgggacttcagtgaagatgtcctgcaaggcttctggatatacattcactgactacaacatgcactgggtgaagcagacccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaaaattgggctacgatgatatctacgacgactggtatttcgatgtctggggcgcagggaccacggtcaccgtctcctcagccaaaacaacagccccatcggtctatccactggcccctgtgtgtggagatacaactggctcctcggtgactctaggatgcctggtcaagggttatttccctgagccagtgaccttgacctggaactctggatccctgtccagtgatgtgcacaccttcccagctctcctgcagtctggcctctacaccctcagcagctcagtgactgtaaccacctggcccagccagaccatcacctgcaatgtggcccacccggcaagcagcaccaaagtggacaagaaaattgagcccagagggtccccaacacataaaccctgtcctccatgcccagctcctaacctcttgggtggaccatccgtcttcatcttccctccaaagatcaaggatgtactcatgatctccctgagccccatggtcacgtgtgtggtggtggatgtgagcgaggatgacccagatgtccatgtcagctggttcgtgaacaacgtggaagtacacacagctcagacacaaacccatagagaggattacaacagtactatccgggtggtcagtgccctccccatccagcaccaggactggatgagtggcaaggagttcaaatgcaaggtcaacaacaaagccctcccagcgcccatcgagagaaccatctcaaaacccaaagggccagtaagagctccacaggtatatgtcttgcctccaccagaagaagagatgactaagaaacaggtcactctgacctgcatgatcacagacttcatgcctgaagacatttacgtggagtggaccaacaacgggcaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 179 - protein, 469 aa, Mus musculus
MGWSWTFLFLLSGTAGVLSEVQLQQSGPELMKPGTSVKMSCKASGYTFTDYNMHWVKQTQGKTLEWIGEINPNSGGAGYNQKFKGKATLTVDKSSTTAYMELRSLTSEDSAVYYCAKLGYDDIYDDWYFDVWGAGTTVTVSSAKTTAPSVYPLAPVCGDTTGSSVTLGCLVKGYFPEPVTLTWNSGSLSSDVHTFPALLQSGLYTLSSSVTVTTWPSQTITCNVAHPASSTKVDKKIEPRGSPTHKPCPPCPAPNLLGGPSVFIFPPKIKDVLMISLSPMVTCVVVDVSEDDPDVHVSWFVNNVEVHTAQTQTHREDYNSTIRVVSALPIQHQDWMSGKEFKCKVNNKALPAPIERTISKPKGPVRAPQVYVLPPPEEEMTKKQVTLTCMITDFMPEDIYVEWTNNGQTELNYKNTEPVLDSDGSYFMYSKLRVEKKNWVERNSYSCSVVHEGLHNHHTTKSFSRTPGK

SEQ ID NO: 180 - DNA, 1407 bp, Mus musculus
atgggatggagctggacctttctcttcctcctgtcaggaactgcaggtgtcctctctgaggtccaactgcaacagtctggacctgaactaatgaagcctgggacttcagtgaagatgtcctgcaaggcttctggatatacattcactgactacaacatgcactgggtgaagcagacccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaaaattgggctacgatgatatctacgacgactggtatttcgatgtctggggcgcagggaccacggtcaccgtctcctcagccaaaacaacagccccatcggtctatccactggcccctgtgtgtggagatacaactggctcctcggtgactctaggatgcctggtcaagggttatttccctgagccagtgaccttgacctggaactctggatccctgtccagtgatgtgcacaccttcccagctctcctgcagtctggcctctacaccctcagcagctcagtgactgtaaccacctggcccagccagaccatcacctgcaatgtggcccacccggcaagcagcaccaaagtggacaagaaaattgagcccagagggtccccaacacataaaccctgtcctccatgcccagctcctaacctcttgggtggaccatccgtcttcatcttccctccaaagatcaaggatgtactcatgatctccctgagccccatggtcacgtgtgtggtggtggatgtgagcgaggatgacccagatgtccatgtcagctggttcgtgaacaacgtggaagtacacacagctcagacacaaacccatagagaggattacaacagtactatccgggtggtcagtgccctccccatccagcaccaggactggatgagtggcaaggagttcaaatgcaaggtcaacaacaaagccctcccagcgcccatcgagagaaccatctcaaaacccaaagggccagtaagagctccacaggtatatgtcttgcctccaccagaagaagagatgactaagaaacaggtcactctgacctgcatgatcacagacttcatgcctgaagacatttacgtggagtggaccaacaacgggcaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 181 - protein, 214 aa, Mus musculus
DIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPLSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 182 - DNA, 645 bp, Mus musculus
gatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccactatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 183 - protein, 234 aa, Mus musculus
MMSSAQFLGLLLLCFQGTRCDIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPLSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 184 - DNA, 705 bp, Mus musculus
atgatgtcctctgctcagttccttggtctcctgttgctctgttttcaaggtaccagatgtgatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccactatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 185 - protein, 447 aa, Mus musculus; identical to SEQ ID NO: 137

SEQ ID NO: 186 - DNA, 1344 bp, Mus musculus
gaggtccaactgcaacagtctggacctgaactaatgaagcctggggcttcagtgaagatgtcctgcaaggcttctggatatacattcactgactacaacatgcactgggtgaagcagaaccaaggaaagaccctagaatggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 187 - protein, 466 aa, Mus musculus; identical to SEQ ID NO: 139

SEQ ID NO: 188 - DNA, 1401 bp, Mus musculus
atgggatggagctggacctttctcttcctcctgtcaggaactgcaggtgtcctctctgaggtccaactgcaacagtctggacctgaactaatgaagcctggggcttcagtgaagatgtcctgcaaggcttctggatatacattcactgactacaacatgcactgggtgaagcagaaccaaggaaagaccctagaatggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 189 - protein, 213 aa, Mus musculus
QIVLSQSPAFLSVSPGDKVTMTCRASSSISYIHWFQQKPGSSPRSWIYATSNLASGVPGRFSGSGSGTSYSLTISRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 190 - DNA, 642 bp, Mus musculus
caaattgttctctcccagtctccagcattcctgtctgtatctccaggggataaggtcacaatgacttgcagggccagctcaagtataagttacatacactggtttcagcagaagccaggatcctcccccagatcctggatttatgccacatccaacctggcttctggagtccctggtcgcttcagtggcagtgggtctgggacctcttactctctcacaatcagcagagtggaggctgaggatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 191 - protein, 235 aa, Mus musculus
MDFQVQIFSFLLISASVIMSRGQIVLSQSPAFLSVSPGDKVTMTCRASSSISYIHWFQQKPGSSPRSWIYATSNLASGVPGRFSGSGSGTSYSLTISRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 192 - DNA, 708 bp, Mus musculus
atggattttcaagtgcagattttcagcttcctgctaatcagtgcttcagtcataatgtccagaggacaaattgttctctcccagtctccagcattcctgtctgtatctccaggggataaggtcacaatgacttgcagggccagctcaagtataagttacatacactggtttcagcagaagccaggatcctcccccagatcctggatttatgccacatccaacctggcttctggagtccctggtcgcttcagtggcagtgggtctgggacctcttactctctcacaatcagcagagtggaggctgaggatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 193 - protein, 445 aa, Mus musculus
EVQLQQSGADLVQPGASVKVSCTASGFDIKDYYIHWMKQRPDQGLEWIGRVDPDNGETEFAPKFPGKATFTTDTSSNTAYLQLRGLTSEDTAIYYCGREDYDGTYTWFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 194 - DNA, 1338 bp, Mus musculus
gaagttcagctgcaacagtctggggcagaccttgtgcagccaggggcctcagtcaaggtgtcctgcacagcttctggcttcgacattaaggactactatatacactggatgaaacagaggcctgaccagggcctggagtggattggaagggttgatcctgacaatggtgagactgaatttgccccgaagttcccgggcaaggccacttttacaacagacacatcctccaacacagcctacctacaactcagaggcctgacatctgaggacactgccatctattactgtgggagagaagactacgatggtacctacacctggtttccttattggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 195 - protein, 464 aa, Mus musculus
MKCSWVIFFLMAVVTGVNSEVQLQQSGADLVQPGASVKVSCTASGFDIKDYYIHWMKQRPDQGLEWIGRVDPDNGETEFAPKFPGKATFTTDTSSNTAYLQLRGLTSEDTAIYYCGREDYDGTYTWFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 196 - DNA, 1395 bp, Mus musculus
atgaaatgcagctgggtcatcttcttcctgatggcagtggttacaggggtcaattcagaagttcagctgcaacagtctggggcagaccttgtgcagccaggggcctcagtcaaggtgtcctgcacagcttctggcttcgacattaaggactactatatacactggatgaaacagaggcctgaccagggcctggagtggattggaagggttgatcctgacaatggtgagactgaatttgccccgaagttcccgggcaaggccacttttacaacagacacatcctccaacacagcctacctacaactcagaggcctgacatctgaggacactgccatctattactgtgggagagaagactacgatggtacctacacctggtttccttattggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 197 - protein, 214 aa, Mus musculus
DLQMTQTTSSLSASLGDRVTISCRASQDISNYLNWYQQKPDGTVKLLIFYTSTLQSGVPSRFSGSGSGTNYSLTITNLEQDDAATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 198 - DNA, 645 bp, Mus musculus
gatctccagatgacacagactacttcctccctgtctgcctctctgggagacagagtcaccatcagttgcagggcaagtcaggacattagcaattatttaaactggtatcagcagaaaccagatggaactgttaagctcctgatcttctacacatcaacattacagtcaggagtcccatcgaggttcagtggcagtgggtctggaacaaattattctctcaccattaccaacctggagcaagatgatgctgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 199 - protein, 234 aa, Mus musculus
MMSSAQFLGLLLLCFQGSRCDLQMTQTTSSLSASLGDRVTISCRASQDISNYLNWYQQKPDGTVKLLIFYTSTLQSGVPSRFSGSGSGTNYSLTITNLEQDDAATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 200 - DNA, 705 bp, Mus musculus
atgatgtcctctgctcagttccttggtctcctgttgctctgttttcaaggttccagatgtgatctccagatgacacagactacttcctccctgtctgcctctctgggagacagagtcaccatcagttgcagggcaagtcaggacattagcaattatttaaactggtatcagcagaaaccagatggaactgttaagctcctgatcttctacacatcaacattacagtcaggagtcccatcgaggttcagtggcagtgggtctggaacaaattattctctcaccattaccaacctggagcaagatgatgctgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 201 - protein, 447 aa, Mus musculus
EVQLQQSGPELMKPGASVKMSCKASGYTFTDYNMHWMKQNQGKSLEWIGEINPNSGGSGYNQKFKGKATLTVDKSSSTAYMELRSLTSEDSAVYYCARLGYYGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 202 - DNA, 1344 bp, Mus musculus
gaggtccagttgcaacagtctggacctgaactaatgaagcctggggcttcagtgaagatgtcctgcaaggcttctggatacacattcactgactacaacatgcactggatgaagcagaaccaaggaaagagcctagagtggataggagagattaatcctaacagtggtggttctggttacaaccagaagttcaaaggcaaggccacattgactgtagacaagtcctccagcacagcctacatggagctccgcagcctgacatctgaggactctgcagtctattactgtgcaagattgggctactatggtaactacgaggactggtatttcgatgtctggggcgcagggaccacggtcaccgtctcctctgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 203 - protein, 466 aa, Mus musculus
MGWSWTFLFLLSGTSGVLSEVQLQQSGPELMKPGASVKMSCKASGYTFTDYNMHWMKQNQGKSLEWIGEINPNSGGSGYNQKFKGKATLTVDKSSSTAYMELRSLTSEDSAVYYCARLGYYGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 204 - DNA, 1401 bp, Mus musculus
atgggatggagctggacctttctcttcctcctgtcaggaacttcgggtgtcctctctgaggtccagttgcaacagtctggacctgaactaatgaagcctggggcttcagtgaagatgtcctgcaaggcttctggatacacattcactgactacaacatgcactggatgaagcagaaccaaggaaagagcctagagtggataggagagattaatcctaacagtggtggttctggttacaaccagaagttcaaaggcaaggccacattgactgtagacaagtcctccagcacagcctacatggagctccgcagcctgacatctgaggactctgcagtctattactgtgcaagattgggctactatggtaactacgaggactggtatttcgatgtctggggcgcagggaccacggtcaccgtctcctctgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 205 - protein, 215 aa, Mus musculus
QIVLTQSPAIMSASPGEKVTMTCRASSSVTSSYLNWYQQKPGSSPKLWIYSTSNLASGVPARFSGSGSGTSYSLTISSVEAEDAATYYCQQYDFFPSTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 206 - DNA, 645 bp, Mus musculus
cagattgttctcacccagtctccagcaatcatgtctgcatctccaggggagaaggtcaccatgacctgcagggccagctcaagtgtaacttccagttacttgaactggtaccagcagaagccaggatcttcccccaaactctggatttatagcacatccaacctggcttcaggagtcccagctcgcttcagtggcagtgggtctgggacctcttactctctcacaatcagcagtgtggaggctgaggatgctgccacttattactgccagcagtatgattttttcccatcgacgttcggtggaggcaccaagctggaaatcaagcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccatcgtcaagagcttcaacaggaatgagtgt

SEQ ID NO: 207 - protein, 237 aa, Mus musculus
MDSQVQIFSFLLISALVKMSRGQIVLTQSPAIMSASPGEKVTMTCRASSSVTSSYLNWYQQKPGSSPKLWIYSTSNLASGVPARFSGSGSGTSYSLTISSVEAEDAATYYCQQYDFFPSTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 208 - DNA, 711 bp, Mus musculus
atggattctcaagtgcagattttcagcttccttctaatcagtgccttagtcaaaatgtccagaggacagattgttctcacccagtctccagcaatcatgtctgcatctccaggggagaaggtcaccatgacctgcagggccagctcaagtgtaacttccagttacttgaactggtaccagcagaagccaggatcttcccccaaactctggatttatagcacatccaacctggcttcaggagtcccagctcgcttcagtggcagtgggtctgggacctcttactctctcacaatcagcagtgtggaggctgaggatgctgccacttattactgccagcagtatgattttttcccatcgacgttcggtggaggcaccaagctggaaatcaagcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccatcgtcaagagcttcaacaggaatgagtgt

SEQ ID NO: 209 - protein, 445 aa, Mus musculus
EVQLQQSGPELVKPGASVKMSCKASGYTFTDYYMNWVKQSHGESLEWIGDINPYNDDTTYNHKFKGKATLTVDKSSNTAYMQLNSLTSEDSAVYYCARETAVITTNAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 210 - DNA, 1335 bp, Mus musculus
gaggtccagctgcaacaatctggacctgagctggtgaagcctggggcttcagtgaagatgtcctgtaaggcttctggatacacattcactgactactacatgaactgggtgaagcagagccatggagagagccttgagtggattggagatattaatccttacaacgatgatactacctacaaccacaagttcaagggcaaggccacattgactgtagacaaatcctccaacacagcctacatgcagctcaacagcctgacatctgaggactctgcagtctattactgtgcaagagagacggccgttattactacgaatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 211 - protein, 464 aa, Mus musculus
MGWNWIFLFLLSGTAGVYSEVQLQQSGPELVKPGASVKMSCKASGYTFTDYYMNWVKQSHGESLEWIGDINPYNDDTTYNHKFKGKATLTVDKSSNTAYMQLNSLTSEDSAVYYCARETAVITTNAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 212 - DNA, 1392 bp, Mus musculus
atgggatggaactggatctttctcttcctcttgtcaggaactgcaggtgtctactctgaggtccagctgcaacaatctggacctgagctggtgaagcctggggcttcagtgaagatgtcctgtaaggcttctggatacacattcactgactactacatgaactgggtgaagcagagccatggagagagccttgagtggattggagatattaatccttacaacgatgatactacctacaaccacaagttcaagggcaaggccacattgactgtagacaaatcctccaacacagcctacatgcagctcaacagcctgacatctgaggactctgcagtctattactgtgcaagagagacggccgttattactacgaatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 213 - protein, 215 aa, Artificial Sequence
  Synthetic Polypeptide
  MISC_FEATURE: Humanized Antibody Sequence
DIQLTQSPSFLSASVGDRVTITCRASSSVTSSYLNWYQQKPGKAPKLLIYSTSNLASGVPSRFSGSGSGTEFTLTISSLQPEDFATYYCQQYDFFPSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 214 - DNA, 645 bp, Artificial Sequence
  Synthetic Polynucleotide
  misc_feature: Humanized Antibody Sequence
gacatccagctgacccagagccccagcttcctttccgcatccgttggtgaccgagtaacaatcacatgccgcgcctcatcttcagttacatcttcttatcttaattggtatcaacaaaaaccaggaaaagcacctaaacttcttatatactctacatctaatctcgcatcaggagttccctctcgattttcaggatctggatcaggcacagaatttacacttactatatcatcactccaaccagaagacttcgccacttattactgccaacaatacgatttttttccaagcacattcggaggaggtacaaaagtagaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 215 - protein, 237 aa, Artificial Sequence
  Synthetic Polypeptide
  MISC_FEATURE: Humanized Antibody Sequence
MDMRVPAQLLGLLLLWLPGARCDIQLTQSPSFLSASVGDRVTITCRASSSVTSSYLNWYQQKPGKAPKLLIYSTSNLASGVPSRFSGSGSGTEFTLTISSLQPEDFATYYCQQYDFFPSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 216 - DNA, 711 bp, Artificial Sequence
  Synthetic Polynucleotide
  misc_feature: Humanized Antibody Sequence
atggacatgagggtccccgctcagctcctggggctcctgctactctggctcccaggtgccagatgtgacatccagctgacccagagccccagcttcctttccgcatccgttggtgaccgagtaacaatcacatgccgcgcctcatcttcagttacatcttcttatcttaattggtatcaacaaaaaccaggaaaagcacctaaacttcttatatactctacatctaatctcgcatcaggagttccctctcgattttcaggatctggatcaggcacagaatttacacttactatatcatcactccaaccagaagacttcgccacttattactgccaacaatacgatttttttccaagcacattcggaggaggtacaaaagtagaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 217 - protein, 447 aa, Artificial Sequence
  Synthetic Polypeptide
  MISC_FEATURE: Humanized Antibody Sequence
EVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 218 - DNA, 1341 bp, Artificial Sequence
  Synthetic Polynucleotide
  misc_feature: Humanized Antibody Sequence
gaggtgcagctggtgcagagcggcgccgaggtcaagaaacctggagcaagcgtaaaggttagttgcaaagcatctggatacacatttaccgactactacatgaattgggtacgacaagcccctggacaaagacttgaatggatgggagacattaacccttataacgacgacactacatacaatcataaatttaaaggaagagttacaattacaagagatacatccgcatcaaccgcctatatggaactttcctcattgagatctgaagacactgctgtttattactgtgcaagagaaactgccgttattactactaacgctatggattactggggtcaaggaaccactgttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 219 - protein, 466 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 220 - DNA, 1398 bp, Artificial Sequence
  Synthetic Polynucleotide
  misc_feature: Humanized Antibody Sequence
atggactggacctggaggatcctcttcttggtggcagcagccacaggagcccactccgaggtgcagctggtgcagagcggcgccgaggtcaagaaacctggagcaagcgtaaaggttagttgcaaagcatctggatacacatttaccgactactacatgaattgggtacgacaagcccctggacaaagacttgaatggatgggagacattaacccttataacgacgacactacatacaatcataaatttaaaggaagagttacaattacaagagatacatccgcatcaaccgcctatatggaactttcctcattgagatctgaagacactgctgtttattactgtgcaagagaaactgccgttattactactaacgctatggattactggggtcaaggaaccactgttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 221 - protein, 215 aa, Artificial Sequence
  Synthetic Polypeptide
  MISC_FEATURE: Humanized Antibody Sequence
DIQMTQSPSSLSASVGDRVTITCSVSSTISSNHLHWFQQKPGKAPKSLIYGTSNLASGVPSRFSGSGSGTDFTLTISSLQPEDFATYYCQQWSSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - DNA, 645 bp, Artificial Sequence
  Synthetic Polynucleotide
  misc_feature: Humanized Antibody Sequence
gacatccagatgacccagtctccatcctccctctcagcatccgtaggcgatagagttacaataacatgcagcgtatcatcaactatatcatcaaatcatcttcattggttccaacagaaacccggcaaagcacctaaatcacttatatacggcacatcaaatctcgcatcaggcgttccttcaagattttcaggctctggctcaggcaccgactttactcttacaatatcctccctccaacccgaagacttcgcaacctattactgtcaacaatggtcctcatatccactcacatttggcggcggcacaaaagtagaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 223 - protein, 237 aa, Artificial Sequence
  Synthetic Polypeptide
  MISC_FEATURE: Humanized Antibody Sequence
MDMRVPAQLLGLLLLWLRGARCDIQMTQSPSSLSASVGDRVTITCSVSSTISSNHLHWFQQKPGKAPKSLIYGTSNLASGVPSRFSGSGSGTDFTLTISSLQPEDFATYYCQQWSSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 224 - DNA, 711 bp, Artificial Sequence
  Synthetic Polynucleotide
  misc_feature: Humanized Antibody Sequence
atggacatgagggtccccgctcagctcctggggctcctgctactctggctccgaggtgccagatgtgacatccagatgacccagtctccatcctccctctcagcatccgtaggcgatagagttacaataacatgcagcgtatcatcaactatatcatcaaatcatcttcattggttccaacagaaacccggcaaagcacctaaatcacttatatacggcacatcaaatctcgcatcaggcgttccttcaagattttcaggctctggctcaggcaccgactttactcttacaatatcctccctccaacccgaagacttcgcaacctattactgtcaacaatggtcctcatatccactcacatttggcggcggcacaaaagtagaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 225 - protein, 451 aa, Artificial Sequence
  Synthetic Polypeptide
  MISC_FEATURE: Humanized Antibody Sequence
EVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 226 - DNA, 1353 bp, Artificial Sequence
  Synthetic Polynucleotide
gaggtgcagctggtgcagtctggggctgaggtgaagaagcctggggcctcagtgaaggtctcctgcaaggcttctgacttcaacattaaagacttctatctacactgggtgcgacaggcccctggacaagggcttgagtggattggaaggattgatcctgagaatggtgatactttatatgacccgaagttccaggacaaggtcaccatgaccacagacacgtccaccagcacagcctacatggagctgaggagcctgagatctgacgacacggccgtgtattactgtgcgagagaggcggattatttccacgatggtacctcctactggtacttcgatgtctggggccgtggcaccctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 227 - protein, 470 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 228 - DNA, 1410 bp, Artificial Sequence
  Synthetic Polynucleotide
  misc_feature: Humanized Antibody Sequence
atggactggacctggaggatcctcttcttggtggcagcagccacaggagcccactccgaggtgcagctggtgcagtctggggctgaggtgaagaagcctggggcctcagtgaaggtctcctgcaaggcttctgacttcaacattaaagacttctatctacactgggtgcgacaggcccctggacaagggcttgagtggattggaaggattgatcctgagaatggtgatactttatatgacccgaagttccaggacaaggtcaccatgaccacagacacgtccaccagcacagcctacatggagctgaggagcctgagatctgacgacacggccgtgtattactgtgcgagagaggcggattatttccacgatggtacctcctactggtacttcgatgtctggggccgtggcaccctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 229 - protein, 213 aa, Artificial Sequence
  Synthetic Polypeptide
  MISC_FEATURE: Humanized Antibody Sequence
DIQLTQSPSFLSASVGDRVTITCRASSSISYIHWYQQKPGKAPKLLIYATSNLASGVPSRFSGSGSGTEFTLTISSLQPEDFATYYCQQWSSDPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 230 - DNA, 639 bp, Artificial Sequence
  Synthetic Polynucleotide
  misc_feature: Humanized Antibody Sequence
gacatccagttgacccagtctccatccttcctgtctgcatctgtaggagacagagtcaccatcacttgcagggccagctcaagtataagttacatacactggtatcagcaaaaaccagggaaagcccctaagctcctgatctatgccacatccaacctggcttctggggtcccatcaaggttcagcggcagtggatctgggacagaattcactctcacaatcagcagcctgcagcctgaagattttgcaacttattactgtcagcagtggagtagtgacccactcacgttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 231 - protein, 235 aa, Artificial Sequence
  Synthetic Polypeptide
  MISC_FEATURE: Humanized Antibody Sequence
MDMRVPAQLLGLLLLWLPGARCDIQLTQSPSFLSASVGDRVTITCRASSSISYIHWYQQKPGKAPKLLIYATSNLASGVPSRFSGSGSGTEFTLTISSLQPEDFATYYCQQWSSDPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 232 - DNA, 705 bp, Artificial Sequence
  Synthetic Polynucleotide
  misc_feature: Humanized Antibody Sequence
atggacatgagggtccccgctcagctcctggggctcctgctgctctggctcccaggtgccagatgtgacatccagttgacccagtctccatccttcctgtctgcatctgtaggagacagagtcaccatcacttgcagggccagctcaagtataagttacatacactggtatcagcaaaaaccagggaaagcccctaagctcctgatctatgccacatccaacctggcttctggggtcccatcaaggttcagcggcagtggatctgggacagaattcactctcacaatcagcagcctgcagcctgaagattttgcaacttattactgtcagcagtggagtagtgacccactcacgttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 233 - protein, 447 aa, Artificial Sequence
  Synthetic Polypeptide
  MISC_FEATURE: Humanized Antibody Sequence
EVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 234 - DNA, 1341 bp, Artificial Sequence
  Synthetic Polynucleotide
  misc_feature: Humanized Antibody Sequence
gaggtgcagctggtgcagtctggggctgaggtgaagaagcctggggcctcagtgaaggtctcctgcaaggcttctggattcgacattaaggactactatatacactgggtgcgacaggcccctggacaagggcttgagtggatcggaagggttgatcctgacaatggtgagactgaatttgccccgaagttcccgggcaaggtcaccatgaccacagacacgtccatcagcacagcctacatggagctgagcaggctgagatctgacgacacggccgtgtattactgtgcgagagaagactacgatggtacctacacctggtttccttattggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 235 - protein, 466 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 236 - DNA, 1398 bp, Artificial Sequence
  Synthetic Polynucleotide
  misc_feature: Humanized Antibody Sequence
atggactggacctggaggatcctcttcttggtggcagcagccacaggagcccactccgaggtgcagctggtgcagtctggggctgaggtgaagaagcctggggcctcagtgaaggtctcctgcaaggcttctggattcgacattaaggactactatatacactgggtgcgacaggcccctggacaagggcttgagtggatcggaagggttgatcctgacaatggtgagactgaatttgccccgaagttcccgggcaaggtcaccatgaccacagacacgtccatcagcacagcctacatggagctgagcaggctgagatctgacgacacggccgtgtattactgtgcgagagaagactacgatggtacctacacctggtttccttattggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 237 - protein, 7 aa, Mus musculus
GTSNLAS

SEQ ID NO: 238 - protein, 8 aa, Mus musculus
QQWTTTYT

SEQ ID NO: 239 - protein, 11 aa, Mus musculus
RASQDISSYLN

SEQ ID NO: 240 - protein, 7 aa, Mus musculus
STSRLNS

SEQ ID NO: 241 - protein, 8 aa, Mus musculus
QQDIKHPT

SEQ ID NO: 242 - protein, 11 aa, Mus musculus
KASQDVFTAVA

SEQ ID NO: 243 - protein, 7 aa, Mus musculus
WASTRHT

SEQ ID NO: 244 - protein, 9 aa, Mus musculus
QQYSSYPLT

SEQ ID NO: 245 - protein, 5 aa, Mus musculus
DYNMH

SEQ ID NO: 246 - protein, 17 aa, Mus musculus
EINPNSGGAGYNQKFKG

SEQ ID NO: 247 - protein, 14 aa, Mus musculus
LGYDDIYDDWYFDV

SEQ ID NO: 248 - protein, 5 aa, Mus musculus
DYNMH

SEQ ID NO: 249 - protein, 17 aa, Mus musculus
EINPNSGGSGYNQKFKG

SEQ ID NO: 250 - protein, 14 aa, Mus musculus
LVYDGSYEDWYFDV

SEQ ID NO: 251 - protein, 5 aa, Mus musculus
DYNMH

SEQ ID NO: 252 - protein, 17 aa, Mus musculus
EINPNSGGAGYNQQFKG

SEQ ID NO: 253 - protein, 14 aa, Mus musculus
LGYVGNYEDWYFDV

SEQ ID NO: 254 - protein, 5 aa, Mus musculus
DYNMH

SEQ ID NO: 255 - protein, 17 aa, Mus musculus
EINPNSGGAGYNQKFKG

SEQ ID NO: 256 - protein, 14 aa, Mus musculus
LGYDDIYDDWYFDV

SEQ ID NO: 257 - protein, 5 aa, Mus musculus
DYNMH

SEQ ID NO: 258 - protein, 17 aa, Mus musculus
EINPNSGGAGYNQKFKG

SEQ ID NO: 259 - protein, 14 aa, Mus musculus
LGYDDIYDDWYFDV

SEQ ID NO: 260 - protein, 5 aa, Mus musculus
DYNMH

SEQ ID NO: 261 - protein, 17 aa, Mus musculus
EINPNSGGAGYNQKFKG

SEQ ID NO: 262 - protein, 14 aa, Mus musculus
LGYDDIYDDWYFDV

SEQ ID NO: 263 - protein, 5 aa, Mus musculus
DYNMH

SEQ ID NO: 264 - protein, 17 aa, Mus musculus
EINPNSGGSGYNQKFKG

SEQ ID NO: 265 - protein, 14 aa, Mus musculus
LGYYGNYEDWYFDV

SEQ ID NO: 266 - protein, 5 aa, Mus musculus
DYYIH

SEQ ID NO: 267 - protein, 17 aa, Mus musculus
RIDPDNGESTYVPKFQG

SEQ ID NO: 268 - protein, 13 aa, Mus musculus
EGLDYGDYYAVDY

SEQ ID NO: 269 - protein, 5 aa, Mus musculus
DYIMH

SEQ ID NO: 270 - protein, 17 aa, Mus musculus
YINPYNDDTEYNEKFKG

SEQ ID NO: 271 - protein, 11 aa, Mus musculus
SIYYYDAPFAY

SEQ ID NO: 272 - protein, 5 aa, Mus musculus
DYYMH

SEQ ID NO: 273 - protein, 17 aa, Mus musculus
RIDPENGDIIYDPKFQG

SEQ ID NO: 274 - protein, 10 aa, Mus musculus
DAGDPAWFTY

SEQ ID NO: 275 - protein, 10 aa, Mus musculus
RASSSVYYMH

SEQ ID NO: 276 - protein, 7 aa, Mus musculus
ATSNLAS

SEQ ID NO: 277 - protein, 9 aa, Mus musculus
QQWSSDPLT

SEQ ID NO: 278 - protein, 12 aa, Mus musculus
SVSSTISSNHLH

SEQ ID NO: 279 - protein, 7 aa, Mus musculus
GTSNLAS

SEQ ID NO: 280 - protein, 9 aa, Mus musculus
QQWSSYPLT

SEQ ID NO: 281 - protein, 10 aa, Mus musculus
RASSSISYIH

SEQ ID NO: 282 - protein, 7 aa, Mus musculus
ATSNLAS

SEQ ID NO: 283 - protein, 9 aa, Mus musculus
QQWSSDPLT

SEQ ID NO: 284 - protein, 12 aa, Mus musculus
RASSSVTSSYLN

SEQ ID NO: 285 - protein, 7 aa, Mus musculus
STSNLAS

SEQ ID NO: 286 - protein, 9 aa, Mus musculus
QQYDFFPST

SEQ ID NO: 287 - protein, 5 aa, Mus musculus
DYFIH

SEQ ID NO: 288 - protein, 17 aa, Mus musculus
RLDPEDGESDYAPKFQD

SEQ ID NO: 289 - protein, 12 aa, Mus musculus
EDYDGTYTFFPY

SEQ ID NO: 290 - protein, 5 aa, Mus musculus
DFYLH

SEQ ID NO: 291 - protein, 17 aa, Mus musculus
RIDPENGDTLYDPKFQD

SEQ ID NO: 292 - protein, 16 aa, Mus musculus
EADYFHDGTSYWYFDV

SEQ ID NO: 293 - protein, 5 aa, Mus musculus
DYYIH

SEQ ID NO: 294 - protein, 17 aa, Mus musculus
RVDPDNGETEFAPKFPG

SEQ ID NO: 295 - protein, 12 aa, Mus musculus
EDYDGTYTWFPY

SEQ ID NO: 296 - protein, 5 aa, Mus musculus
DYYMN

SEQ ID NO: 297 - protein, 17 aa, Mus musculus
DINPYNDDTTYNHKFKG

SEQ ID NO: 298 - protein, 11 aa, Mus musculus
ETAVITTNAMD

SEQ ID NO: 299 - protein, 130 aa, Mus musculus
MDFQVQIFSFMLISVTVILSSGEIVLTQSPALMAASPGEKVTITCSVSSSISSSNLHWSQQKSGTSPKLWIYGTSNLASGVPVRFSGSGSGTSYSLTISSMEAEDAATYYCQQWTTTYTFGSGTKLELKR

SEQ ID NO: 300 - DNA, 390 bp, Mus musculus
atggattttcaggtgcagattttcagcttcatgctaatcagtgtcacagtcatattgtccagtggagaaattgtgctcacccagtctccagcactcatggctgcatctccaggggagaaggtcaccatcacctgcagtgtcagctcgagtataagttccagcaacttacactggtcccagcagaagtcaggaacctcccccaaactctggatttatggcacatccaaccttgcttctggagtccctgttcgcttcagtggcagtggatctgggacctcttattctctcacaatcagcagcatggaggctgaagatgctgccacttattactgtcaacagtggactactacgtatacgttcggatcggggaccaagctggagctgaaacgt

SEQ ID NO: 301 - protein, 141 aa, Mus musculus
MGWNWIIFFLMAVVTGVNSEVQLRQSGADLVKPGASVKLSCTASGFNIKDYYIHWVKQRPEQGLEWIGRIDPDNGESTYVPKFQGKATITADTSSNTAYLQLRSLTSEDTAIYYCGREGLDYGDYYAVDYWGQGTSVTVSS

SEQ ID NO: 302 - DNA, 423 bp, Mus musculus
atgggatggaactggatcatcttcttcctgatggcagtggttacaggggtcaattcagaggtgcagttgcggcagtctggggcagaccttgtgaagccaggggcctcagtcaagttgtcctgcacagcttctggcttcaacattaaagactactatatacactgggtgaagcagaggcctgaacagggcctggagtggattggaaggattgatcctgataatggtgaaagtacatatgtcccgaagttccagggcaaggccactataacagcagacacatcatccaacacagcctacctacaactcagaagcctgacatctgaggacactgccatctattattgtgggagagaggggctcgactatggtgactactatgctgtggactactggggtcaaggaacctcggtcacagtctcgagc

SEQ ID NO: 303 - protein, 130 aa, Artificial Sequence
  Synthetic Polypeptide
  MISC_FEATURE: Humanized Antibody Sequence
MDMRVPAQLLGLLLLWLPGARCDIQLTQSPSFLSASVGDRVTITCSVSSSISSSNLHWYQQKPGKAPKLLIYGTSNLASGVPSRFSGSGSGTEFTLTISSLQPEDFATYYCQQWTTTYTFGQGTKLEIKR

SEQ ID NO: 304 - DNA, 390 bp, Artificial Sequence
  Synthetic Polynucleotide
  misc_feature: Humanized Antibody Sequence
atggatatgcgcgtgccggcgcagctgctgggcctgctgctgctgtggctgccgggcgcgcgctgcgatattcagctgacccagagcccgagctttctgagcgcgagcgtgggcgatcgcgtgaccattacctgcagcgtgagcagcagcattagcagcagcaacctgcattggtatcagcagaaaccgggcaaagcgccgaaactgctgatttatggcaccagcaacctggcgagcggcgtgccgagccgctttagcggcagcggcagcggcaccgaatttaccctgaccattagcagcctgcagccggaagattttgcgacctattattgccagcagtggaccaccacctatacctttggccagggcaccaaactggaaattaaacgt

SEQ ID NO: 305 - protein, 141 aa, Artificial Sequence
  Synthetic Polypeptide
  MISC_FEATURE: Humanized Antibody Sequence
MDWTWSILFLVAAPTGAHSEVQLVQSGAEVKKPGASVKVSCKASGFNIKDYYIHWVRQAPGQGLEWMGRIDPDNGESTYVPKFQGRVTMTTDTSTSTAYMELRSLRSDDTAVYYCAREGLDYGDYYAVDYWGQGTLVTVSS

SEQ ID NO: 306 - DNA, 423 bp, Artificial Sequence
  Synthetic Polynucleotide
  misc_feature: Humanized Antibody Sequence
atggattggacctggagcattctgtttctggtggcggcgccgaccggcgcgcatagcgaagtgcagctggtgcagagcggcgcggaagtgaaaaaaccgggcgcgagcgtgaaagtgagctgcaaagcgagcggctttaacattaaagattattatattcattgggtgcgccaggcgccgggccagggcctggaatggatgggccgcattgatccggataacggcgaaagcacctatgtgccgaaatttcagggccgcgtgaccatgaccaccgataccagcaccagcaccgcgtatatggaactgcgcagcctgcgcagcgatgataccgcggtgtattattgcgcgcgcgaaggcctggattatggcgattattatgcggtggattattggggccagggcaccctggtgaccgtctcgagc

SEQ ID NO: 307 - protein, 127 aa, Artificial Sequence
  Synthetic Polypeptide
  MISC_FEATURE: Humanized Antibody Sequence
MMSSAQFLGLLLLCFQGTRCDIQMTQTTSSLSASLGDRVNISCRASQDISSYLNWYQQKPDGTVKLLIYSTSRLNSGVPSRFSGSGSGTDYSLTISNLAQEDIATYFCQQDIKHPTFGGGTKLELKR

SEQ ID NO: 308 - DNA, 381 bp, Mus musculus
atgatgtcctctgctcagttccttggtctcctgttgctctgttttcaaggtaccagatgtgatatccagatgacacagactacatcctccctgtctgcctctctgggagacagagtcaacatcagctgcagggcaagtcaggacattagcagttatttaaactggtatcagcagaaaccagatggaactgttaaactcctgatctactccacatcaagattaaactcaggagtcccatcaaggttcagtggcagtgggtctgggacagattattctctcactattagcaacctggcacaagaagatattgccacttacttttgccaacaggatattaagcatccgacgttcggtggaggcaccaagttggagctgaaacgt

SEQ ID NO: 309 - protein, 139 aa, Mus musculus
MEWIWIFLFLLSGTAGVHSEVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSS

SEQ ID NO: 310 - DNA, 417 bp, Mus musculus
atggaatggatctggatatttctcttcctcctgtcaggaactgcaggtgtccactctgaggtccagctgcagcagtctggacctgagctggtaaagcctggggcttcagtgaagatgtcctgcaaggcttctgggttcacattcactgactacattatgcactgggtgaagcagaagcctgggcagggccttgagtggattggatatattaatccttacaatgatgatactgaatacaatgagaagttcaaaggcaaggccacactgacttcagacaaatcctccagcacagcctacatggatctcagcagtctgacctctgagggctctgcggtctattactgtgcaagatcgatttattactacgatgccccgtttgcttactggggccaagggactctggtcacagtctcgagc

SEQ ID NO: 311 - protein, 127 aa, Artificial Sequence
  Synthetic Polypeptide
  MISC_FEATURE: Humanized Antibody Sequence
MMSSAQFLGLLLLCFQGTRCDIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIKR

SEQ ID NO: 312 - DNA, 381 bp, Artificial Sequence
  Synthetic Polynucleotide
  misc_feature: Humanized Antibody Sequence
atgatgtcctctgctcagttccttggtctcctgttgctctgttttcaaggtaccagatgtgatatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaacgt

SEQ ID NO: 313 - protein, 139 aa, Artificial Sequence
  Synthetic Polypeptide
  MISC_FEATURE: Humanized Antibody Sequence
MEWIWIFLFLLSGTAGVHSEVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSS

SEQ ID NO: 314 - protein, 107 aa, Mus musculus
DIQMTQTTSSLSASLGDRVNISCRASQDISSYLNWYQQKPDGTVKLLIYSTSRLNSGVPSRFSGSGSGTDYSLTISNLAQEDIATYFCQQDIKHPTFGGGTKLELKR

SEQ ID NO: 315 - protein, 128 aa, Mus musculus
MKSQTQVFVYMLLWLSGVEGDIVMTQSHKFMSTSVGDRVTITCKASQDVFTAVAWYQQKPGQSPKLLIYWASTRHTGVPDRFTGSGSGTDFTLTISNVQSEDLADYFCQQYSSYPLTFGAGTKLELKR

SEQ ID NO: 316 - DNA, 381 bp, Mus musculus
atgaagtcacagacccaggtctttgtatacatgttgctgtggttgtctggtgttgaaggagacattgtgatgacccagtctcacaaattcatgtccacgtcagtaggagacagggtcaccatcacctgcaaggccagtcaggatgtctttactgctgtagcctggtatcaacagaaaccaggacaatctcctaaactactgatttactgggcatccacccggcacactggagtccctgatcgcttcacaggcagtggatctgggacagatttcactctcaccattagcaatgtgcagtctgaagacttggcagattatttctgtcaacaatatagcagctatcctctcacgttcggtgctgggaccaagttggagctgaaa

SEQ ID NO: 317 - protein, 138 aa, Mus musculus
MGWNWIIFFLMAVVTGVNSEVQLQQSGAELVRPGALVKLSCKASGFNIKDYYMHWVKQRPEQGLEWIGRIDPENGDIIYDPKFQGKASITTDTSSNTAYLQLSSLTSEDTAVYYCAYDAGDPAWFTYWGQGTLVTVSS

SEQ ID NO: 318 - DNA, 411 bp, Mus musculus
atgggatggaactggatcatcttcttcctgatggcagtggttacaggggtcaattcagaggttcagctgcagcagtctggggctgagcttgtgaggccaggggccttagtcaagttgtcctgcaaagcttctggcttcaatattaaagactactatatgcactgggtgaagcagaggcctgaacagggcctggagtggattggaaggattgatcctgagaatggtgatattatatatgacccgaagttccagggcaaggccagtataacaacagacacatcctccaacacagcctacctgcagctcagcagcctgacgtctgaggacactgccgtctattactgtgcttacgatgctggtgaccccgcctggtttacttactggggccaagggactctggtcaccgtctcg

SEQ ID NO: 319 - protein, 130 aa, Mus musculus
MDMRVPAQLLGLLLLWLRGARCDIQMTQSPSSLSASVGDRVTITCKASQDVFTAVAWYQQKPGKAPKLLIYWASTRHTGVPSRFSGSGSGTDFTLTISSLQPEDFATYYCQQYSSYPLTFGGGTKVEIKR

SEQ ID NO: 320 - DNA, 390 bp, Mus musculus
atggatatgcgcgtgccggcgcagctgctgggcctgctgctgctgtggctgcgcggcgcgcgctgcgatatccagatgacccagagcccgagcagcctgagcgcgagcgtgggcgatcgcgtgaccattacctgcaaagcgagccaggatgtgtttaccgcggtggcgtggtatcagcagaaaccgggcaaagcgccgaaactgctgatttattgggcgagcacccgccataccggcgtgccgagtcgctttagcggcagcggcagcggcaccgattttaccctgaccattagcagcctgcagccggaagattttgcgacctattattgccagcagtatagcagctatccgctgacctttggcggcggcaccaaagtggaaattaaacgt

SEQ ID NO: 321 - protein, 138 aa, Artificial Sequence
  Synthetic Polypeptide
  MISC_FEATURE: Humanized Antibody Sequence
MDWTWSILFLVAAPTGAHSEVQLVQSGAEVKKPGASVKVSCKASGFNIKDYYMHWVRQAPGQGLEWIGRIDPENGDIIYDPKFQGRVTMTTDTSTSTAYMELRSLRSDDTAVYYCAYDAGDPAWFTYWGQGTLVTVSS

SEQ ID NO: 322 - DNA, 414 bp, Artificial Sequence
  Synthetic Polynucleotide
  misc_feature: Humanized Antibody Sequence
atggattggacctggagcattctgtttctggtggcggcgccgaccggcgcgcatagcgaagtgcagctggtgcagagcggcgcggaagtgaaaaaaccgggcgcgagcgtgaaagtgagctgcaaagcgagcggctttaacattaaagattattatatgcattgggtgcgccaggcgccgggccagggcctggaatggatcggccgcattgatccggaaaacggcgatattatttatgatccgaaatttcagggccgcgtgaccatgaccaccgataccagcaccagcaccgcgtatatggaactgcgcagcctgcgcagcgatgataccgcggtgtattattgcgcgtatgatgcgggcgatccggcgtggtttacctattggggccagggcaccctggtgaccgtctcgagc

SEQ ID NO: 323 - protein, 106 aa, Mus musculus
TDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 324 - protein, 320 aa, Mus musculus
AKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSH

SEQ ID NO: 325 - protein, 106 aa, Homo sapiens
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 327 - protein, 120 aa, Mus musculus
EVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSS

SEQ ID NO: 328 - protein, 120 aa, Mus musculus; identical to SEQ ID NO: 327

SEQ ID NO: 329 - protein, 120 aa, Mus musculus
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSS

SEQ ID NO: 330 - protein, 226 aa, Mus musculus
EVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSSTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 331 - protein, 447 aa, Mus musculus
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 332 - protein, 107 aa, Mus musculus
DIQMTQITSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIK

SEQ ID NO: 333 - protein, 324 aa, Mus musculus
AKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 334 - protein, 213 aa, Mus musculus
DIQMTQTTSSLSASLGDRVNISCRASQDISSYLNWYQQKPDGTVKLLIYSTSRLNSGVPSRFSGSGSGTDYSLTISNLAQEDIATYFCQQDIKHPTFGGGTKLELKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 335 - protein, 444 aa, Mus musculus
EVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 336 - protein, 108 aa, Mus musculus
DIQMTQSPSSLSASVGDRVTITCKASQDVFTAVAWYQQKPGKAPKLLIYWASTRHTGVPSRFSGSGSGTDFTLTISSLQPEDFATYYCQQYSSYPLTFGGGTKVEIKR

SEQ ID NO: 337 - DNA, 324 bp, Mus musculus
gatatccagatgacccagagcccgagcagcctgagcgcgagcgtgggcgatcgcgtgaccattacctgcaaagcgagccaggatgtgtttaccgcggtggcgtggtatcagcagaaaccgggcaaagcgccgaaactgctgatttattgggcgagcacccgccataccggcgtgccgagtcgctttagcggcagcggcagcggcaccgattttaccctgaccattagcagcctgcagccggaagattttgcgacctattattgccagcagtatagcagctatccgctgacctttggcggcggcaccaaagtggaaattaaacgt

SEQ ID NO: 338 - protein, 119 aa, Mus musculus
EVQLVQSGAEVKKPGASVKVSCKASGFNIKDYYMHWVRQAPGQGLEWIGRIDPENGDIIYDPKFQGRVTMTTDTSTSTAYMELRSLRSDDTAVYYCAYDAGDPAWFTYWGQGTLVTVSS

SEQ ID NO: 339 - DNA, 357 bp, Mus musculus
gaagtgcagctggtgcagagcggcgcggaagtgaaaaaaccgggcgcgagcgtgaaagtgagctgcaaagcgagcggctttaacattaaagattattatatgcattgggtgcgccaggcgccgggccagggcctggaatggatcggccgcattgatccggaaaacggcgatattatttatgatccgaaatttcagggccgcgtgaccatgaccaccgataccagcaccagcaccgcgtatatggaactgcgcagcctgcgcagcgatgataccgcggtgtattattgcgcgtatgatgcgggcgatccggcgtggtttacctattggggccagggcaccctggtgaccgtctcgagc

SEQ ID NO: 340 - DNA, 1395 bp, Mus musculus
atggactggacctggaggatcctcttcttggtggcagcagccacaggagcccactccgaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 341 - protein, 213 aa, Mus musculus
DIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 342 - DNA, 639 bp, Mus musculus
gacatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 343 - protein, 235 aa, Mus musculus
MDMRVPAQLLGLLLLWLRGARCDIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 344 - DNA, 705 bp, Mus musculus
atggacatgagggtgcccgctcagctcctggggctcctgctgctgtggctgagaggtgccagatgtgacatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 345 - protein, 446 aa, Mus musculus
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 346 - DNA, 1338 bp, Mus musculus
gaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 347 - protein, 465 aa, Mus musculus
MDWTWRILFLVAAATGAHSEVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 348 - DNA, 1395 bp, Mus musculus; identical to SEQ ID NO: 340

SEQ ID NO: 349 - DNA, 417 bp, Mus musculus
atggaatggatctggatatttctcttcctcctgtcaggaactgcaggtgtccactctgaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcacagtctcgagc

SEQ ID NO: 350 - protein, 218 aa, Mus musculus
DIVLTQSPASLAVSLGQRATIACKASQSVDYDGTSYMNWYQQKPGQPPKLLIYAASNLESEIPARFSGTGSGTDFTLNIHPVEEEDITTYYCQQSNEDPFTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 351 - protein, 15 aa, Mus musculus
KASQSVDYDGTSYMN

SEQ ID NO: 352 - protein, 7 aa, Mus musculus
AASNLES

SEQ ID NO: 353 - protein, 9 aa, Mus musculus
QQSNEDPFT

SEQ ID NO: 354 - DNA, 657 bp, Mus musculus
gacattgtgttgacccagtctccagcttctttggctgtgtctctagggcagagggccaccatcgcctgcaaggccagccaaagtgttgattatgatggtactagttatatgaattggtaccaacagaaaccaggacagccacccaaactcctcatctatgctgcatccaatctagaatctgagatcccagccaggtttagtggcactgggtctgggacagacttcaccctcaacatccatcctgtggaggaggaggatatcacaacctattactgtcagcaaagtaatgaggatccgttcacgttcggaggggggaccaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 355 - protein, 238 aa, Mus musculus
METDTILLWVLLLWVPGSTGDIVLTQSPASLAVSLGQRATIACKASQSVDYDGTSYMNWYQQKPGQPPKLLIYAASNLESEIPARFSGTGSGTDFTLNIHPVEEEDITTYYCQQSNEDPFTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 356 - DNA, 717 bp, Mus musculus
atggagacagacacaatcctgctatgggtgctgctgctctgggttccaggctccactggtgacattgtgttgacccagtctccagcttctttggctgtgtctctagggcagagggccaccatcgcctgcaaggccagccaaagtgttgattatgatggtactagttatatgaattggtaccaacagaaaccaggacagccacccaaactcctcatctatgctgcatccaatctagaatctgagatcccagccaggtttagtggcactgggtctgggacagacttcaccctcaacatccatcctgtggaggaggaggatatcacaacctattactgtcagcaaagtaatgaggatccgttcacgttcggaggggggaccaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 357 - protein, 442 aa, Mus musculus
QVQLQQPGTELVRPGTSVKLSCKASGYIFTTYWMNWVKQRPGQGLEWIGMIHPSASEIRLDQKFKDKATLTLDKSSSTAYMHLSGPTSVDSAVYYCARSGEWGSMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 358 - protein, 5 aa, Mus musculus
TYWMN

SEQ ID NO: 359 - protein, 17 aa, Mus musculus
MIHPSASEIRLDQKFKD

SEQ ID NO: 360 - protein, 9 aa, Mus musculus
SGEWGSMDY

SEQ ID NO: 361 - DNA, 1329 bp, Mus musculus
caggtccaactacagcagcctgggactgagctggtgaggcctggaacttcagtgaagttgtcctgtaaggcttctggctacatcttcaccacctactggatgaactgggtgaaacagaggcctggacaaggccttgagtggattggcatgattcatccttccgcaagtgaaattaggttggatcagaaattcaaggacaaggccacattgactcttgacaaatcctccagcacagcctatatgcacctcagcggcccgacatctgtggattctgcggtctattactgtgcaagatcaggggaatgggggtctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 362 - protein, 461 aa, Mus musculus
MGWSSIILFLVATATGVHSQVQLQQPGTELVRPGTSVKLSCKASGYIFTTYWMNWVKQRPGQGLEWIGMIHPSASEIRLDQKFKDKATLTLDKSSSTAYMHLSGPTSVDSAVYYCARSGEWGSMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 363 - DNA, 1386 bp, Mus musculus
atgggatggagctctatcatcctcttcttggtagcaacagctacaggtgtccactcccaggtccaactacagcagcctgggactgagctggtgaggcctggaacttcagtgaagttgtcctgtaaggcttctggctacatcttcaccacctactggatgaactgggtgaaacagaggcctggacaaggccttgagtggattggcatgattcatccttccgcaagtgaaattaggttggatcagaaattcaaggacaaggccacattgactcttgacaaatcctccagcacagcctatatgcacctcagcggcccgacatctgtggattctgcggtctattactgtgcaagatcaggggaatgggggtctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 364 - protein, 106 aa, Mus musculus
DIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIK

SEQ ID NO: 365 - DNA, 318 bp, Mus musculus
gacatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaa

SEQ ID NO: 366 - protein, 120 aa, Mus musculus; identical to SEQ ID NO: 329

SEQ ID NO: 367 - DNA, 360 bp, Mus musculus
gaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcaccgtctctagt

SEQ ID NO: 368 - protein, 108 aa, Mus musculus; identical to SEQ ID NO: 336

SEQ ID NO: 369 - DNA, 324 bp, Mus musculus; identical to SEQ ID NO: 337

SEQ ID NO: 370 - protein, 119 aa, Mus musculus; identical to SEQ ID NO: 338

SEQ ID NO: 371 - DNA, 357 bp, Mus musculus; identical to SEQ ID NO: 339

SEQ ID NO: 372 - protein, 108 aa, Mus musculus
DIQLTQSPSFLSASVGDRVTITCSVSSSISSSNLHWYQQKPGKAPKLLIYGTSNLASGVPSRFSGSGSGTEFTLTISSLQPEDFATYYCQQWTTTYTFGQGTKLEIKR

SEQ ID NO: 373 - DNA, 324 bp, Mus musculus
gatattcagctgacccagagcccgagctttctgagcgcgagcgtgggcgatcgcgtgaccattacctgcagcgtgagcagcagcattagcagcagcaacctgcattggtatcagcagaaaccgggcaaagcgccgaaactgctgatttatggcaccagcaacctggcgagcggcgtgccgagccgctttagcggcagcggcagcggcaccgaatttaccctgaccattagcagcctgcagccggaagattttgcgacctattattgccagcagtggaccaccacctatacctttggccagggcaccaaactggaaattaaacgt

SEQ ID NO: 374 - protein, 122 aa, Mus musculus
EVQLVQSGAEVKKPGASVKVSCKASGFNIKDYYIHWVRQAPGQGLEWMGRIDPDNGESTYVPKFQGRVTMTTDTSTSTAYMELRSLRSDDTAVYYCAREGLDYGDYYAVDYWGQGTLVTVSS

SEQ ID NO: 375 - DNA, 366 bp, Mus musculus
gaagtgcagctggtgcagagcggcgcggaagtgaaaaaaccgggcgcgagcgtgaaagtgagctgcaaagcgagcggctttaacattaaagattattatattcattgggtgcgccaggcgccgggccagggcctggaatggatgggccgcattgatccggataacggcgaaagcacctatgtgccgaaatttcagggccgcgtgaccatgaccaccgataccagcaccagcaccgcgtatatggaactgcgcagcctgcgcagcgatgataccgcggtgtattattgcgcgcgcgaaggcctggattatggcgattattatgcggtggattattggggccagggcaccctggtgaccgtctcgagc

SEQ ID NO: 376 - protein, 107 aa, Mus musculus [sequence omitted]

SEQ ID NO: 377 - DNA, 321 bp, Mus musculus
gacatccagatgacccagtctccatcctccctctccgcatccgtaggcgaccgcgtaaccataacatgtagagcatctcaagatatttccaactatttgaattggtaccaacaaaaacccggcaaagcacctaaactcctcatttactatacatcaagactcctctccggcgttccatcacgattctcaggctccggctccggcacagatttcacactcactatttcctccctccaaccagaagattttgcaacctattactgtcaacaaggcgatacactcccatacacattcggcggcggcacaaaagttgaaattaaa

SEQ ID NO: 378 - protein, 123 aa, Mus musculus [sequence omitted]

SEQ ID NO: 379 - DNA, 369 bp, Mus musculus
gaggtgcagctggtgcagagcggcgccgaggtaaaaaaaccaggagcaagcgttaaagtttcttgtaaagcaagcggatatacatttacagattacaacatgcattgggtaagacaagcgccaggacaaggattggaatggatgggcgaaattaaccctaatagtggaggagcaggctacaatcaaaaattcaaagggagagttacaatgacaacagacacaagcacttcaacagcatatatggaactgcgatcacttagaagcgacgatacagctgtatactattgcgcacgacttgggtatgatgatatatatgatgactggtatttcgatgtttggggccagggaacaacagttaccgtctctagt

SEQ ID NO: 380 - protein, 108 aa, Mus musculus
DIQLTQSPSFLSASVGDRVTITCRASSSVTSSYLNWYQQKPGKAPKLLIYSTSNLASGVPSRFSGSGSGTEFTLTISSLQPEDFATYYCQQYDFFPSTFGGGTKVEIK

SEQ ID NO: 381 - DNA, 324 bp, Mus musculus
gacatccagctgacccagagccccagcttcctttccgcatccgttggtgaccgagtaacaatcacatgccgcgcctcatcttcagttacatcttcttatcttaattggtatcaacaaaaaccaggaaaagcacctaaacttcttatatactctacatctaatctcgcatcaggagttccctctcgattttcaggatctggatcaggcacagaatttacacttactatatcatcactccaaccagaagacttcgccacttattactgccaacaatacgatttttttccaagcacattcggaggaggtacaaaagtagaaatcaag

SEQ ID NO: 382 - protein, 121 aa, Mus musculus
EVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSS

SEQ ID NO: 383 - DNA, 363 bp, Mus musculus
gaggtgcagctggtgcagagcggcgccgaggtcaagaaacctggagcaagcgtaaaggttagttgcaaagcatctggatacacatttaccgactactacatgaattgggtacgacaagcccctggacaaagacttgaatggatgggagacattaacccttataacgacgacactacatacaatcataaatttaaaggaagagttacaattacaagagatacatccgcatcaaccgcctatatggaactttcctcattgagatctgaagacactgctgtttattactgtgcaagagaaactgccgttattactactaacgctatggattactggggtcaaggaaccactgttaccgtctctagt

SEQ ID NO: 384 - protein, 108 aa, Mus musculus
DIQMTQSPSSLSASVGDRVTITCSVSSTISSNHLHWFQQKPGKAPKSLIYGTSNLASGVPSRFSGSGSGTDFTLTISSLQPEDFATYYCQQWSSYPLTFGGGTKVEIK

SEQ ID NO: 385 - DNA, 324 bp, Mus musculus
gacatccagatgacccagtctccatcctccctctcagcatccgtaggcgatagagttacaataacatgcagcgtatcatcaactatatcatcaaatcatcttcattggttccaacagaaacccggcaaagcacctaaatcacttatatacggcacatcaaatctcgcatcaggcgttccttcaagattttcaggctctggctcaggcaccgactttactcttacaatatcctccctccaacccgaagacttcgcaacctattactgtcaacaatggtcctcatatccactcacatttggcggcggcacaaaagtagaaattaaa

SEQ ID NO: 386 - protein, 125 aa, Mus musculus
EVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSS

SEQ ID NO: 387 - DNA, 375 bp, Mus musculus
gaggtgcagctggtgcagtctggggctgaggtgaagaagcctggggcctcagtgaaggtctcctgcaaggcttctgacttcaacattaaagacttctatctacactgggtgcgacaggcccctggacaagggcttgagtggattggaaggattgatcctgagaatggtgatactttatatgacccgaagttccaggacaaggtcaccatgaccacagacacgtccaccagcacagcctacatggagctgaggagcctgagatctgacgacacggccgtgtattactgtgcgagagaggcggattatttccacgatggtacctcctactggtacttcgatgtctggggccgtggcaccctggtcaccgtctctagt

SEQ ID NO: 388 - protein, 106 aa, Mus musculus
DIQLTQSPSFLSASVGDRVTITCRASSSISYIHWYQQKPGKAPKLLIYATSNLASGVPSRFSGSGSGTEFTLTISSLQPEDFATYYCQQWSSDPLTFGGGTKVEIK

SEQ ID NO: 389 - DNA, 318 bp, Mus musculus
gacatccagttgacccagtctccatccttcctgtctgcatctgtaggagacagagtcaccatcacttgcagggccagctcaagtataagttacatacactggtatcagcaaaaaccagggaaagcccctaagctcctgatctatgccacatccaacctggcttctggggtcccatcaaggttcagcggcagtggatctgggacagaattcactctcacaatcagcagcctgcagcctgaagattttgcaacttattactgtcagcagtggagtagtgacccactcacgttcggcggagggaccaaggtggagatcaaa

SEQ ID NO: 390 - protein, 121 aa, Mus musculus
EVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSS

SEQ ID NO: 391 - DNA, 363 bp, Mus musculus
gaggtgcagctggtgcagtctggggctgaggtgaagaagcctggggcctcagtgaaggtctcctgcaaggcttctggattcgacattaaggactactatatacactgggtgcgacaggcccctggacaagggcttgagtggatcggaagggttgatcctgacaatggtgagactgaatttgccccgaagttcccgggcaaggtcaccatgaccacagacacgtccatcagcacagcctacatggagctgagcaggctgagatctgacgacacggccgtgtattactgtgcgagagaagactacgatggtacctacacctggtttccttattggggccaagggactctggtcaccgtctctagt

SEQ ID NO: 392 - protein, 448 aa, Artificial Sequence
  Synthetic Polypeptide
  MISC_FEATURE: Humanized Antibody Sequence
EVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 393 - protein, 446 aa, Artificial Sequence
  Synthetic Polypeptide
  MISC_FEATURE: Humanized Antibody Sequence
EVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 394 - protein, 450 aa, Artificial Sequence
  Synthetic Polypeptide
  MISC_FEATURE: Humanized Antibody Sequence
EVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 395 - protein, 446 aa, Artificial Sequence
  Synthetic Polypeptide
  MISC_FEATURE: Humanized Antibody Sequence
EVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 396 - protein, 445 aa, Artificial Sequence
  Synthetic Polypeptide
  MISC_FEATURE: Humanized Antibody Sequence
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 397 - protein, 213 aa, Homo sapiens
MQLPLALCLVCLLVHTAFRVVEGQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 398 - protein, 444 aa, Artificial
  Miscellaneous construct
QVQLVQSGAEVKKPGSSVKVSCKASGYTFTDYFLNWVRQAPGQGLEWMGTIYPYHDGTTYSQKFKGRVTITADKSTSTAYMELSSLRSEDTAVYYCAREEEDGQFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 399 - protein, 444 aa, Artificial
  Miscellaneous construct
QVQLVQSGAEVKKPGASVKVSCKVSGFPIKDTFQHWVRQAPGKGLEWMGWSDPEIGDTEYASKFQGRVTMTEDTSTDTAYMELSSLRSEDTAVYYCATGDTTYKFDFWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 400 - protein, 450 aa, Artificial
  Miscellaneous construct
EVQLVQSGAEVKKPGESLKISCKGSDFEIKDYYIHWVRQMPGKGLEWMGQIDAEDGETEYAPRFQGQVTISADKSISTAYLQWSSLKASDTAMYYCAREGYYYDGRDYWYFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 401 - protein, 214 aa, Artificial
  Miscellaneous construct
DIQMTQSPSSLSASVGDRVTITCSASQGIQWYLNWYQQKPGKAPKLLIYYTSSLHSGVPSRFSGSGSGTDFTLTISSLQPEDFATYYCQQHSKLPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 402 - protein, 214 aa, Artificial
  Miscellaneous construct
DIQMTQSPSSLSASVGDRVTITCKASQDVHTAVAWYQQKPGKAPKLLIYWASTRWTGVPSRFSGSGSGTDFTLTISSLQPEDFATYYCQQYSDYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 403 - protein, 213 aa, Artificial
  Miscellaneous construct
EIVLTQSPATLSLSPGERATLSCSASSSVSYIHWYQQKPGQAPRLLIYSTSELASGIPARFSGSGSGTDFTLTISSLEPEDFAVYYCQQLSHLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 404 - DNA, 1332 bp, Artificial
  Miscellaneous construct
caggtgcagctggtgcagtctggggctgaggtgaagaagcctgggtcctcagtgaaggtttcctgcaaggcatctggatacacattcactgactactttctgaactgggtgcgacaggcccctggacaagggcttgagtggatgggaactatttatccttaccatgatggtactacctactctcagaagttcaagggcagagtcaccattaccgcggacaaatccacgagcacagcctacatggagctgagcagcctgagatctgaggacacggccgtgtattactgtgcgagagaggaagaggatggtcagttcgactactggggccaaggaaccacggtcaccgtctcctcagcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggt

SEQ ID NO: 405 - DNA, 1332 bp, Artificial
  Miscellaneous construct
caggttcagctggtgcagtctggggctgaggtgaagaagcctggggcctcagtgaaggtctcctgcaaggtttccggcttccccattaaggacacctttcagcactgggtgcgacaggctcctggaaaagggcttgagtggatgggatggagcgatcctgagatcggtgatactgaatatgcctcgaagttccagggcagagtcaccatgaccgaggacacatctacagacacagcctacatggagctgagcagcctgagatctgaggacacggccgtgtattactgtgcaacaggcgacaccacatacaagtttgacttctgggggcaagggaccacggtcaccgtctcctcagcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggt

SEQ ID NO: 406 - DNA, 1350 bp, Artificial
  Miscellaneous construct
gaggtgcagctggtgcagtctggagcagaggtgaaaaagcccggggagtctctgaagatctcctgtaagggttctgacttcgagattaaagactactatatacattgggtgcgccagatgcccgggaaaggcctggagtggatggggcagattgatgctgaggatggtgaaactgaatatgccccgaggttccagggccaggtcaccatctcagccgacaagtccatcagcaccgcctacctgcagtggagcagcctgaaggcctcggacaccgccatgtattactgtgcgagagagggttattactacgatgggcgcgactactggtacttcgatgtctggggccaagggaccacggtcaccgtctcctcagcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggt

SEQ ID NO: 407 - DNA, 642 bp, Artificial
  Miscellaneous construct
gacatccagatgacccagtctccatcctctctgtctgcatctgtaggagacagagtcaccatcacttgcagtgcaagtcagggcattcagtggtatttaaactggtatcagcagaaaccagggaaagcccctaagctcctgatctattacacatcaagtttacactcaggggtcccatcaaggttcagtggcagtggatctgggacagatttcactctcaccatcagcagtctgcaacctgaagattttgcaacttactactgtcagcagcatagtaaacttcctcggacgttcggcggagggaccaaggtggagatcaaacggactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 408 - DNA, 642 bp, Artificial
  Miscellaneous construct
gacatccagatgacccagtctccatcctccctgtctgcatctgtaggagacagagtcaccatcacttgcaaggccagtcaggatgtgcacactgctgtagcctggtatcagcagaaaccagggaaagcccctaagctcctgatctattgggcatccacccggtggactggagtcccatcaaggttcagtggcagtggatctgggacagatttcactctcaccatcagcagtctgcaacctgaagattttgcaacttactactgtcagcaatatagcgattatccgtggacgttcggcggagggaccaaggtggagatcaaacggactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 409 - DNA, 639 bp, Artificial
  Miscellaneous construct
gaaattgtgttgacacagtctccagccaccctgtctttgtctccaggggaaagagccaccctctcctgcagtgccagctcaagtgtaagttacatccactggtaccaacagaaacctggccaggctcccaggctcctcatctatagcacatccgagctggcttctggcatcccagccaggttcagtggcagtgggtctgggacagacttcactctcaccatcagcagcctagagcctgaagattttgcagtttattactgtcagcagcttagtcatctcccgctcacgttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 410 - protein, 118 aa, Artificial
  Miscellaneous construct
QVQLVQSGAEVKKPGSSVKVSCKASGYTFTDYFLNWVRQAPGQGLEWMGTIYPYHDGTTYSQKFKGRVTITADKSTSTAYMELSSLRSEDTAVYYCAREEEDGQFDYWGQGTTVTVSS

SEQ ID NO: 411 - protein, 118 aa, Artificial [sequence omitted]

SEQ ID NO: 412 - protein, 124 aa, Artificial
  Miscellaneous construct
EVQLVQSGAEVKKPGESLKISCKGSDFEIKDYYIHWVRQMPGKGLEWMGQIDAEDGETEYAPRFQGQVTISADKSISTAYLQWSSLKASDTAMYYCAREGYYYDGRDYWYFDVWGQGTTVTVSS

SEQ ID NO: 413 - protein, 107 aa, Artificial
  Miscellaneous construct
DIQMTQSPSSLSASVGDRVTITCSASQGIQWYLNWYQQKPGKAPKLLIYYTSSLHSGVPSRFSGSGSGTDFTLTISSLQPEDFATYYCQQHSKLPRTFGGGTKVEIK

SEQ ID NO: 414 - protein, 107 aa, Artificial [sequence omitted]

SEQ ID NO: 415 - protein, 106 aa, Artificial
  Miscellaneous construct
EIVLTQSPATLSLSPGERATLSCSASSSVSYIHWYQQKPGQAPRLLIYSTSELASGIPARFSGSGSGTDFTLTISSLEPEDFAVYYCQQLSHLPLTFGGGTKVEIK

SEQ ID NO: 416 - protein, 10 aa, Artificial
  Miscellaneous construct
GYTFTDYFLN

SEQ ID NO: 417 - protein, 17 aa, Artificial
  Miscellaneous construct
TIYPYHDGTTYSQKFKG

SEQ ID NO: 418 - protein, 9 aa, Artificial
  Miscellaneous construct
EEEDGQFDY

SEQ ID NO: 419 - protein, 11 aa, Artificial
  Miscellaneous construct
SASQGIQWYLN

SEQ ID NO: 420 - protein, 7 aa, Artificial
  Miscellaneous construct
YTSSLHS

SEQ ID NO: 421 - protein, 9 aa, Artificial
  Miscellaneous construct
QQHSKLPRT

SEQ ID NO: 422 - protein, 10 aa, Artificial
  Miscellaneous construct
GFPIKDTFQH

SEQ ID NO: 423 - protein, 17 aa, Artificial
  Miscellaneous construct
WSDPEIGDTEYASKFQG

SEQ ID NO: 424 - protein, 9 aa, Artificial
  Miscellaneous construct
GDTTYKFDF

SEQ ID NO: 425 - protein, 11 aa, Artificial
  Miscellaneous construct
KASQDVHTAVA

SEQ ID NO: 426 - protein, 7 aa, Artificial
  Miscellaneous construct
WASTRWT

SEQ ID NO: 427 - protein, 9 aa, Artificial
  Miscellaneous construct
QQYSDYPWT

SEQ ID NO: 428 - protein, 10 aa, Artificial
  Miscellaneous construct
DFEIKDYYIH

SEQ ID NO: 429 - protein, 17 aa, Artificial
  Miscellaneous construct
QIDAEDGETEYAPRFQG

SEQ ID NO: 430 - protein, 17 aa, Artificial
  Miscellaneous construct
QIDAEDGETEYAPRFQG

SEQ ID NO: 431 - protein, 17 aa, Artificial
  Miscellaneous construct
QIDAEDGETEYAPRFQG

SEQ ID NO: 432 - protein, 7 aa, Artificial
  Miscellaneous construct
STSELAS

SEQ ID NO: 433 - protein, 9 aa, Artificial
  Miscellaneous construct
QQLSHLPLT

SEQ ID NO: 434 - protein, 322 aa, Artificial
  Miscellaneous construct
GPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 435 - DNA, 970 bp, Artificial
  Miscellaneous construct
ggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccgctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggttga

SEQ ID NO: 436 - protein, 444 aa, Artificial
  Miscellaneous construct
EVQLQQSVAELVRPGASVKLSCTASGFNIKSTFMHWVKQRPDQGLEWIGWIDPENGDTEYASKFQGKATMTADTSSNTAYLQLSSLTSEDTAVYYCTTGESNYDFDFWGLGTTLTVSSAKTTPPSVYPLAPGTALKSNSMVTLGCLVKGYFPEPVTVTWNSGALSSGVHTFPAVLQSGLYTLTSSVTVPSSTWPSQTVTCNVAHPASSTKVDKKIVPRNCGGDCKPCICTGSEVSSVFIFPPKPKDVLTITLTPKVTCVVVDISQDDPEVHFSWFVDDVEVHTAQTRPPEEQFNSTFRSVSELPILHQDWLNGRTFRCKVTSAAFPSPIEKTISKPEGRTQVPHVYTMSPTKEEMTQNEVSITCMVKGFYPPDIYVEWQMNGQPQENYKNTPPTMDTDGSYFLYSKLNVKKEKWQQGNTFTCSVLHEGLHNHHTEKSLSHSPGK

SEQ ID NO: 437 - protein, 214 aa, Artificial
  Miscellaneous construct
DIVMTQSHKFMSTSVGDRVSITCKASQDVSTAVAWYQQKPGQSPKLLIYWASTRHTGVPDRFTGSGSGTDYTLTISDVQSEDLADYFCQQYSNYPWTFGGGTKLEIKRADAAPTVSIFPPSTEQLATGGASVVCLMNNFYPRDISVKWKIDGTERRDGVLDSVTDQDSKDSTYSMSSTLSLSKADYESHNLYTCEVVHKTSSSPVVKSFNRNEC

SEQ ID NO: 438 - protein, 450 aa, Artificial
  Miscellaneous construct
EVQLQQSGAEHVKPGASVKLSCTASDFNIKDYYIHWVKQRTAQGLEWIGRIDPEDGETEYAPRFQGKATIIADTSSNTAYLQLSSLTSEDTAVYYCAREGYYYDSRDYWYFDVWGTGTTVTVSSAKTTPPSVYPLAPGTALKSNSMVTLGCLVKGYFPEPVTVTWNSGALSSGVHTFPAVLQSGLYTLTSSVTVPSSTWPSQTVTCNVAHPASSTKVDKKIVPRNCGGDCKPCICTGSEVSSVFIFPPKPKDVLTITLTPKVTCVVVDISQDDPEVHFSWFVDDVEVHTAQTRPPEEQFNSTFRSVSELPILHQDWLNGRTFRCKVTSAAFPSPIEKTISKPEGRTQVPHVYTMSPTKEEMTQNEVSITCMVKGFYPPDIYVEWQMNGQPQENYKNTPPTMDTDGSYFLYSKLNVKKEKWQQGNTFTCSVLHEGLHNHHTEKSLSHSPGK

SEQ ID NO: 439 - protein, 213 aa, Artificial
  Miscellaneous construct
EIVLTQSPALMSASPGEKVTMTCSASSSVSYMHWFQQKPGTSPKLWIYSTSNLASGVPARFSGSGSGTSYSLTISSMEAEDAATYYCQQWSSNPLTFGAGTKLELKRADAAPTVSIFPPSTEQLATGGASVVCLMNNFYPRDISVKWKIDGTERRDGVLDSVTDQDSKDSTYSMSSTLSLSKADYESHNLYTCEVVHKTSSSPVVKSFNRNEC

SEQ ID NO: 440 - protein, 10 aa, Homo sapiens
GFTFSSYVMN

SEQ ID NO: 441 - protein, 10 aa, Homo sapiens
GFTFRSHWLS

SEQ ID NO: 442 - protein, 10 aa, Homo sapiens
GFTFSSYVMN

SEQ ID NO: 443 - protein, 10 aa, Homo sapiens
GFTFRSHWLS

SEQ ID NO: 444 - protein, 10 aa, Homo sapiens
GFTFRSHWLS

SEQ ID NO: 445 - protein, 10 aa, Homo sapiens
GFTFRSHWLS

SEQ ID NO: 446 - protein, 10 aa, Homo sapiens
GFTFRSHWLS

SEQ ID NO: 447 - protein, 10 aa, Homo sapiens
GFTFRSHWLS

SEQ ID NO: 448 - protein, 10 aa, Homo sapiens
GFTFRSHWLS

SEQ ID NO: 449 - protein, 10 aa, Homo sapiens
GFTFRSHWLS

SEQ ID NO: 450 - protein, 10 aa, Homo sapiens
GFTFRSHWLS

SEQ ID NO: 451 - protein, 20 aa, Homo sapiens
WVSFISGDSSNTYYADSVKG

SEQ ID NO: 452 - protein, 20 aa, Homo sapiens
WVSNINYDGSSTYYADSVKG

SEQ ID NO: 453 - protein, 20 aa, Homo sapiens
WVSFISGDSSNTYYADSVKG

SEQ ID NO: 454 - protein, 20 aa, Homo sapiens
WVSNINYDGSSTYYADSVKG

SEQ ID NO: 455 - protein, 19 aa, Homo sapiens
WVSVTGVHGDTYYADSVKG

SEQ ID NO: 456 - protein, 19 aa, Homo sapiens
WVSVIGNWGDTYYADSVKG

SEQ ID NO: 457 - protein, 19 aa, Homo sapiens
WVSVTTHQGYTYYADSVKG

SEQ ID NO: 458 - protein, 19 aa, Homo sapiens
WVSATNRYGYTYYADSVKG

SEQ ID NO: 459 - protein, 20 aa, Homo sapiens
WVSNINYDGSSTYYADSVKG

SEQ ID NO: 460 - protein, 19 aa, Homo sapiens
WVSVITPYGDTYYADSVKG

SEQ ID NO: 461 - protein, 19 aa, Homo sapiens
WVSVITPYGDTYYADSVKG

SEQ ID NO: 462 - protein, 15 aa, Homo sapiens
TFMHGHLGGGLSMDF

SEQ ID NO: 463 - protein, 8 aa, Homo sapiens
DTYLHFDY

SEQ ID NO: 464 - protein, 15 aa, Homo sapiens
TFMHGHLGGGLSMDF

SEQ ID NO: 465 - protein, 8 aa, Homo sapiens
DTYLHFDY

SEQ ID NO: 466 - protein, 8 aa, Homo sapiens
DTYLHFDY

SEQ ID NO: 467 - protein, 8 aa, Homo sapiens
DTYLHFDY

SEQ ID NO: 468 - protein, 8 aa, Homo sapiens
DTYLHFDY

SEQ ID NO: 469 - protein, 8 aa, Homo sapiens
DTYLHFDY

SEQ ID NO: 470 - protein, 8 aa, Homo sapiens
DTYLHFDY

SEQ ID NO: 471 - protein, 8 aa, Homo sapiens
DTYLHFDY

SEQ ID NO: 472 - protein, 8 aa, Homo sapiens
DTYLHFDY

SEQ ID NO: 473 - protein, 11 aa, Homo sapiens
SGDNIGSFYVH

SEQ ID NO: 474 - protein, 20 aa, Homo sapiens
WVSNINYDGSSTYYADSVKG

SEQ ID NO: 475 - protein, 20 aa, Homo sapiens
WVSNINYDGSSTYYADSVKG

SEQ ID NO: 476 - protein, 11 aa, Homo sapiens
SGDNIGSFYVH

SEQ ID NO: 477 - protein, 14 aa, Homo sapiens
TGTSSDVGDINDVS

SEQ ID NO: 478 - protein, 14 aa, Homo sapiens
TGTSSDVGDINDVS

SEQ ID NO: 479 - protein, 14 aa, Homo sapiens
TGTSSDVGDINDVS

SEQ ID NO: 480 - protein, 14 aa, Homo sapiens
TGTSSDVGDINDVS

SEQ ID NO: 481 - protein, 14 aa, Homo sapiens
TGTSSDVGDINDVS

SEQ ID NO: 482 - protein, 14 aa, Homo sapiens
TGTSSDVGDINDVS

SEQ ID NO: 483 - protein, 14 aa, Homo sapiens
TGTSSDVGDINDVS

SEQ ID NO: 484 - protein, 11 aa, Homo sapiens
LVIYDDNNRPS

SEQ ID NO: 485 - protein, 11 aa, Homo sapiens
LMIYDVNNRPS

SEQ ID NO: 486 - protein, 11 aa, Homo sapiens
LVIYDDNNRPS

SEQ ID NO: 487 - protein, 11 aa, Homo sapiens
LMIYDVNNRPS

SEQ ID NO: 488 - protein, 11 aa, Homo sapiens
LMIYDVNNRPS

SEQ ID NO: 489 - protein, 11 aa, Homo sapiens
LMIYDVNNRPS

SEQ ID NO: 490 - protein, 11 aa, Homo sapiens
LMIYDVNNRPS

SEQ ID NO: 491 - protein, 11 aa, Homo sapiens
LMIYDVNNRPS

SEQ ID NO: 492 - protein, 11 aa, Homo sapiens
LMIYDVNNRPS

SEQ ID NO: 493 - protein, 11 aa, Homo sapiens
LMIYDVNNRPS

SEQ ID NO: 494 - protein, 11 aa, Homo sapiens
LMIYDVNNRPS

SEQ ID NO: 495 - protein, 10 aa, Homo sapiens
GSWAGSSGSY

SEQ ID NO: 496 - protein, 10 aa, Homo sapiens
SSYGESLTSY

SEQ ID NO: 497 - protein, 10 aa, Homo sapiens
ASWTGVEPDY

SEQ ID NO: 498 - protein, 10 aa, Homo sapiens
QSYAGSYLSE

SEQ ID NO: 499 - protein, 10 aa, Homo sapiens
SSYGESLTSY

SEQ ID NO: 500 - protein, 10 aa, Homo sapiens
SSYGESLTSY

SEQ ID NO: 501 - protein, 10 aa, Homo sapiens
SSYGESLTSY

SEQ ID NO: 502 - protein, 10 aa, Homo sapiens
SSYGESLTSY

SEQ ID NO: 503 - protein, 10 aa, Homo sapiens
STYDGPGLSE

SEQ ID NO: 504 - protein, 10 aa, Homo sapiens
SSYGESLTSY

SEQ ID NO: 505 - protein, 10 aa, Homo sapiens
SSYGESLTSY

SEQ ID NO: 506 - protein, 124 aa, Homo sapiens
QVQLVESGGGLVQPGGSLRLSCAASGFTFSSYVMNWVRQAPGKGLEWVSFISGDSSNTYYADSVKGRFTISRDNSKNTLYLQMNSLRAEDTAVYYCARTFMHGHLGGGLSMDFWGQGTLVTVSS

SEQ ID NO: 507 - protein, 117 aa, Homo sapiens
QVQLVESGGGLVQPGGSLRLSCAASGFTFRSHWLSWVRQAPGKGLEWVSNINYDGSSTYYADSVKGRFTISRDNSKNTLYLQMNSLRAEDTAVYYCARDTYLHFDYWGQGTLVTVSS

SEQ ID NO: 508 - protein, 124 aa, Homo sapiens; identical to SEQ ID NO: 506

SEQ ID NO: 509 - protein, 117 aa, Homo sapiens; identical to SEQ ID NO: 507

SEQ ID NO: 510 - protein, 116 aa, Homo sapiens
QVQLVESGGGLVQPGGSLRLSCAASGFTFRSHWLSWVRQAPGKGLEWVSVTGVHGDTYYADSVKGRFTISRDNSKNTLYLQMNSLRAEDTAVYYCARDTYLHFDYWGQGTLVTVSS

SEQ ID NO: 511 - protein, 116 aa, Homo sapiens
QVQLVESGGGLVQPGGSLRLSCAASGFTFRSHWLSWVRQAPGKGLEWVSVIGNWGDTYYADSVKGRFTISRDNSKNTLYLQMNSLRAEDTAVYYCARDTYLHFDYWGQGTLVTVSS

SEQ ID NO: 512 - protein, 116 aa, Homo sapiens
QVQLVESGGGLVQPGGSLRLSCAASGFTFRSHWLSWVRQAPGKGLEWVSVTTHQGYTYYADSVKGRFTISRDNSKNTLYLQMNSLRAEDTAVYYCARDTYLHFDYWGQGTLVTVSS

SEQ ID NO: 513 - protein, 116 aa, Homo sapiens
QVQLVESGGGLVQPGGSLRLSCAASGFTFRSHWLSWVRQAPGKGLEWVSATNRYGYTYYADSVKGRFTISRDNSKNTLYLQMNSLRAEDTAVYYCARDTYLHFDYWGQGTLVTVSS

SEQ ID NO: 514 - protein, 117 aa, Homo sapiens; identical to SEQ ID NO: 507

SEQ ID NO: 515 - protein, 116 aa, Homo sapiens
QVQLVESGGGLVQPGGSLRLSCAASGFTFRSHWLSWVRQAPGKGLEWVSVITPYGDTYYADSVKGRFTISRDNSKNTLYLQMNSLRAEDTAVYYCARDTYLHFDYWGQGTLVTVSS

SEQ ID NO: 516 - protein, 116 aa, Homo sapiens; identical to SEQ ID NO: 515

SEQ ID NO: 517 - protein, 110 aa, Homo sapiens
DIELTQPPSVSVAPGQTARISCSGDNIGSFYVHWYQQKPGQAPVLVIYDDNNRPSGIPERFSGSNSGNTATLTISGTQAEDEADYYCGSWAGSSGSYVFGGRTKLTVLGQ

SEQ ID NO: 518 - protein, 113 aa, Homo sapiens
DIALTQPASVSGSPGQSITISCTGTSSDVGDINDVSWYQQHPGKAPKLMIYDVNNRPSGVSNRFSGSKSGNTASLTISGLQAEDEADYYCSSYGESLTSYVFGGGTKLTVLGQ

SEQ ID NO: 519 - protein, 110 aa, Homo sapiens
DIELTQPPSVSVAPGQTARISCSGDNIGSFYVHWYQQKPGQAPVLVIYDDNNRPSGIPERFSGSNSGNTATLTISGTQAEDEADYYCASWTGVEPDYVFGGGTKLTVLGQ

SEQ ID NO: 520 - protein, 113 aa, Homo sapiens
DIALTQPASVSGSPGQSITISCTGTSSDVGDINDVSWYQQHPGKAPKLMIYDVNNRPSGVSNRFSGSKSGNTASLTISGLQAEDEADYYCQSYAGSYLSEVFGGGTKLTVLGQ

SEQ ID NO: 521 - protein, 113 aa, Homo sapiens; identical to SEQ ID NO: 518

SEQ ID NO: 522 - protein, 113 aa, Homo sapiens; identical to SEQ ID NO: 518

SEQ ID NO: 523 - protein, 113 aa, Homo sapiens; identical to SEQ ID NO: 518

SEQ ID NO: 524 - protein, 113 aa, Homo sapiens; identical to SEQ ID NO: 518

SEQ ID NO: 525 - protein, 113 aa, Homo sapiens
DIALTQPASVSGSPGQSITISCTGTSSDVGDINDVSWYQQHPGKAPKLMIYDVNNRPSGVSNRFSGSKSGNTASLTISGLQAEDEADYYCSTYDGPGLSEVFGGGTKLTVLGQ

SEQ ID NO: 526 - protein, 113 aa, Homo sapiens; identical to SEQ ID NO: 518

SEQ ID NO: 527 - protein, 113 aa, Homo sapiens; identical to SEQ ID NO: 525

SEQ ID NO: 528 - DNA, 372 bp, Homo sapiens
caggtgcaattggtggaaagcggcggcggcctggtgcaaccgggcggcagcctgcgtctgagctgcgcggcctccggatttaccttttcttcttatgttatgaattgggtgcgccaagcccctgggaagggtctcgagtgggtgagctttatctctggtgattctagcaatacctattatgcggatagcgtgaaaggccgttttaccatttcacgtgataattcgaaaaacaccctgtatctgcaaatgaacagcctgcgtgcggaagatacggccgtgtattattgcgcgcgtacttttatgcatggtcatcttggtggtggtctttctatggatttttggggccaaggcaccctggtgacggttagctca

SEQ ID NO: 529 - DNA, 350 bp, Homo sapiens
caggtgcaattggtggaaagcggcggcggcctggtgcaaccgggcggcagcctgcgtctagctgcgcggcctccggatttacctttcgttctcattggctttcttgggtgcgccaagcccctgggaagggtctcgagtgggtgagcaatatcaattatgatggtagctctacctattatgcggatagcgtgaaaggccgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 530 - DNA, 372 bp, Homo sapiens; identical to SEQ ID NO: 528

SEQ ID NO: 531 - DNA, 351 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcaatatcaattatgatggtagctctacctattatgcggatagcgtgaaaggccgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 532 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttactggtgttcatggtgatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 533 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttattggtaattggggtgatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 534 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttactactcatcagggttatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 535 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgctactaatcgttatggttatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 536 - DNA, 351 bp, Homo sapiens; identical to SEQ ID NO: 531

SEQ ID NO: 537 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttattactccttatggtgatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 538 - DNA, 348 bp, Homo sapiens; identical to SEQ ID NO: 537

SEQ ID NO: 539 - DNA, 330 bp, Homo sapiens
gatatcgaactgacccagccgccttcagtgagcgttgcaccaggtcagaccgcgcgtatctcgtgtagcggcgataatattggttctttttatgttcattggtaccagcagaaacccgggcaggcgccagttcttgtgatttatgatgataataatcgtccctcaggcatcccggaacgctttagcggatccaacagcggcaacaccgcgaccctgaccattagcggcactcaggcggaagacgaagcggattattattgcggttcttgggctggttcttctggttcttatgtgtttggcggccgcacgaagttaaccgttcttggccag

SEQ ID NO: 540 - DNA, 339 bp, Homo sapiens
gatatcgcactgacccagccagcttcagtgagcggctcaccaggtcagagcattaccatctcgtgtacgggtactagcagcgatgttggtgatattaatgatgtgtcttggtaccagcagcatcccgggaaggcgccgaaacttatgatttatgatgttaataatcgtccctcaggcgtgagcaaccgttttagcggatccaaaagcggcaacaccgcgagcctgaccattagcggcctgcaagcggaagacgaagcggattattattgctcttcttatggtgagtctcttacttcttatgtgtttggcggcggcacgaagttaaccgttcttggccag

SEQ ID NO: 541 - DNA, 330 bp, Homo sapiens
gatatcgaactgacccagccgccttcagtgagcgttgcaccaggtcagaccgcgcgtatctcgtgtagcggcgataatattggttctttttatgttcattggtaccagcagaaacccgggcaggcgccagttcttgtgatttatgatgataataatcgtccctcaggcatcccggaacgctttagcggatccaacagcggcaacaccgcgaccctgaccattagcggcactcaggcggaagacgaagcggattattattgcgcttcttggactggtgttgagcctgattatgtgtttggcggcggcacgaagttaaccgttcttggccag

SEQ ID NO: 542 - DNA, 339 bp, Homo sapiens
gatatcgcactgacccagccagcttcagtgagcggctcaccaggtcagagcattaccatctcgtgtacgggtactagcagcgatgttggtgatattaatgatgtgtcttggtaccagcagcatcccgggaaggcgccgaaacttatgatttatgatgttaataatcgtccctcaggcgtgagcaaccgttttagcggatccaaaagcggcaacaccgcgagcctgaccattagcggcctgcaagcggaagacgaagcggattattattgccagtcttatgctggttcttatctttctgaggtgtttggcggcggcacgaagttaaccgttcttggccag

SEQ ID NO: 543 - DNA, 339 bp, Homo sapiens; identical to SEQ ID NO: 540

SEQ ID NO: 544 - DNA, 339 bp, Homo sapiens; identical to SEQ ID NO: 540

SEQ ID NO: 545 - DNA, 339 bp, Homo sapiens; identical to SEQ ID NO: 540

SEQ ID NO: 546 - DNA, 339 bp, Homo sapiens; identical to SEQ ID NO: 540

SEQ ID NO: 547 - DNA, 339 bp, Homo sapiens
gatatcgcactgacccagccagcttcagtgagcggctcaccaggtcagagcattaccatctcgtgtacgggtactagcagcgatgttggtgatattaatgatgtgtcttggtaccagcagcatcccgggaaggcgccgaaacttatgatttatgatgttaataatcgtccctcaggcgtgagcaaccgttttagcggatccaaaagcggcaacaccgcgagcctgaccattagcggcctgcaagcggaagacgaagcggattattattgctctacttatgatggtcctggtctttctgaggtgtttggcggcggcacgaagttaaccgttcttggccag

SEQ ID NO: 548 - DNA, 339 bp, Homo sapiens; identical to SEQ ID NO: 540

SEQ ID NO: 549 - DNA, 339 bp, Homo sapiens; identical to SEQ ID NO: 547

SEQ ID NO: 550 - protein, 469 aa, Homo sapiens
MAWVWTLPFLMAAAQSVQAQVQLVESGGGLVQPGGSLRLSCAASGFTFSSYVMNWVRQAPGKGLEWVSFISGDSSNTYYADSVKGRFTISRDNSKNTLYLQMNSLRAEDTAVYYCARTFMHGHLGGGLSMDFWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 551 - protein, 462 aa, Homo sapiens
MAWVWTLPFLMAAAQSVQAQVQLVESGGGLVQPGGSLRLSCAASGFTFRSHWLSWVRQAPGKGLEWVSNINYDGSSTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 552 - protein, 469 aa, Homo sapiens; identical to SEQ ID NO: 550

SEQ ID NO: 553 - protein, 462 aa, Homo sapiens; identical to SEQ ID NO: 551

SEQ ID NO: 554 - protein, 461 aa, Homo sapiens
MAWVWTLPFLMAAAQSVQAQVQLVESGGGLVQPGGSLRLSCAASGFTFRSHWLSWVRQAPGKGLEWVSVTGVHGDTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 555 - protein, 461 aa, Homo sapiens
MAWVWTLPFLMAAAQSVQAQVQLVESGGGLVQPGGSLRLSCAASGFTFRSHWLSWVRQAPGKGLEWVSVIGNWGDTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 556 - protein, 461 aa, Homo sapiens
MAWVWTLPFLMAAAQSVQAQVQLVESGGGLVQPGGSLRLSCAASGFTFRSHWLSWVRQAPGKGLEWVSVTTHQGYTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 557 - protein, 465 aa, Homo sapiens
MKHLWFFLLLVAAPRWVLSQVQLVESGGGLVQPGGSLRLSCAASGFTFRSHWLSWVRQAPGKGLEWVSATNRYGYTYYADSVKGRFTISRDNSKNTLYLQMNSLRAEDTAVYYCARDTYLHFDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 558 - protein, 462 aa, Homo sapiens; identical to SEQ ID NO: 551

SEQ ID NO: 559 - protein, 461 aa, Homo sapiens
MAWVWTLPFLMAAAQSVQAQVQLVESGGGLVQPGGSLRLSCAASGFTFRSHWLSWVRQAPGKGLEWVSVITPYGDTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 560 - protein, 461 aa, Homo sapiens; identical to SEQ ID NO: 559

SEQ ID NO: 561 - protein, 130 aa, Homo sapiens
MSVLTQVLALLLLWLTGTRCDIELTQPPSVSVAPGQTARISCSGDNIGSFYVHWYQQKPGQAPVLVIYDDNNRPSGIPERFSGSNSGNTATLTISGTQAEDEADYYCGSWAGSSGSYVFGGRTKLTVLGQ

SEQ ID NO: 562 - protein, 237 aa, Homo sapiens
MSVLTQVLALLLLWLTGTRCDIALTQPASVSGSPGQSITISCTGTSSDVGDINDVSWYQQHPGKAPKLMIYDVNNRPSGVSNRFSGSKSGNTASLTISGLQAEDEADYYCSSYGESLTSYVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 563 - protein, 234 aa, Homo sapiens
MSVLTQVLALLLLWLTGTRCDIELTQPPSVSVAPGQTARISCSGDNIGSFYVHWYQQKPGQAPVLVIYDDNNRPSGIPERFSGSNSGNTATLTISGTQAEDEADYYCASWTGVEPDYVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 564 - protein, 237 aa, Homo sapiens
MSVLTQVLALLLLWLTGTRCDIALTQPASVSGSPGQSITISCTGTSSDVGDINDVSWYQQHPGKAPKLMIYDVNNRPSGVSNRFSGSKSGNTASLTISGLQAEDEADYYCQSYAGSYLSEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 565 - protein, 237 aa, Homo sapiens; identical to SEQ ID NO: 562

SEQ ID NO: 566 - protein, 237 aa, Homo sapiens; identical to SEQ ID NO: 562

SEQ ID NO: 567 - protein, 237 aa, Homo sapiens; identical to SEQ ID NO: 562

SEQ ID NO: 568 - protein, 237 aa, Homo sapiens; identical to SEQ ID NO: 562

SEQ ID NO: 569 - protein, 237 aa, Homo sapiens
MSVLTQVLALLLLWLTGTRCDIALTQPASVSGSPGQSITISCTGTSSDVGDINDVSWYQQHPGKAPKLMIYDVNNRPSGVSNRFSGSKSGNTASLTISGLQAEDEADYYCSTYDGPGLSEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 570 - protein, 237 aa, Homo sapiens; identical to SEQ ID NO: 562

SEQ ID NO: 571 - protein, 237 aa, Homo sapiens; identical to SEQ ID NO: 569

SEQ ID NO: 572 - DNA, 1410 bp, Homo sapiens
atggcttgggtgtggaccttgccattcctgatggcagctgcccaaagcgtgcaggcccaggtgcagctggtcgagtctggcggcggactggtgcagcctggcggcagcctgagactgagctgcgccgccagcggcttcaccttcagcagctacgtgatgaactgggtgcggcaggcccctggcaagggcctggagtgggtgtccttcatcagcggcgacagcagcaacacctactacgccgacagcgtgaagggccggttcaccatcagccgggacaacagcaagaacaccctgtacctgcagatgaacagcctgcgggccgaggacaccgccgtgtactactgcgcccggaccttcatgcacggccacctgggcggaggactgagcatggatttctggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 573 - DNA, 1389 bp, Homo sapiens
atggcttgggtgtggaccttgccattcctgatggcagctgcccaaggtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccaacatcaactacgacggcagcagcacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 574 - DNA, 1410 bp, Homo sapiens; identical to SEQ ID NO: 572

SEQ ID NO: 575 - DNA, 1389 bp, Homo sapiens
atggcttgggtgtggaccttgccattcctgatggcagctgcccaaggtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccaacatcaactacgacggcagcagcacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagagacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 576 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgaccggcgtgcacggcgacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 577 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgatcggcaactggggcgacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 578 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgaccacccaccagggctacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 579 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgccaccaacagatacggctacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 580 - DNA, 1389 bp, Homo sapiens; identical to SEQ ID NO: 573

SEQ ID NO: 581 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgatcaccccctacggcgacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 582 - DNA, 1386 bp, Homo sapiens; identical to SEQ ID NO: 581

SEQ ID NO: 583 - DNA, 393 bp, Homo sapiens
atgaaaaagacagctatcgcgattgcagtggcactggctggtttcgctaccgtagcgcaggccgatatcgaactgacccagccgccttcagtgagcgttgcaccaggtcagaccgcgcgtatctcgtgtagcggcgataatattggttctttttatgttcattggtaccagcagaaacccgggcaggcgccagttcttgtgatttatgatgataataatcgtccctcaggcatcccggaacgctttagcggatccaacagcggcaacaccgcgaccctgaccattagcggcactcaggcggaagacgaagcggattattattgcggttcttgggctggttcttctggttcttatgtgtttggcggccgcacgaagttaaccgttcttggccag

SEQ ID NO: 584 - DNA, 714 bp, Homo sapiens
atgagtgtgctcactcaggtcctggcgttgctgctgctgtggcttacaggtacgcgttgcgacatcgccctgacccagcccgccagcgtgagcggcagccctggccagagcatcaccatcagctgcaccggcaccagcagcgacgtgggcgacatcaacgacgtgagctggtatcagcagcaccccggcaaggcccccaagctgatgatctacgacgtgaacaaccggcccagcggcgtgagcaaccggttcagcggcagcaagagcggcaacaccgccagcctgaccatcagcggcctccaggccgaggacgaggccgactactactgcagcagctacggcgagagcctgaccagctacgtgtttggcggcggaaccaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 585 - DNA, 705 bp, Homo sapiens
atgagtgtgctcactcaggtcctggcgttgctgctgctgtggcttacaggtacgcgttgcgacatcgagctgacccagccccccagcgtgagcgtggcccctggccagaccgcccggatcagctgcagcggcgacaacatcggcagcttctacgtgcactggtatcagcagaagcccggccaggcccccgtgctggtgatctacgacgacaacaaccggcccagcggcatccccgagcggttcagcggcagcaacagcggcaacaccgccaccctgaccatcagcggcacccaggccgaggacgaggccgactactactgcgccagctggaccggcgtggagcccgactacgtgtttggcggcggaacaaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 586 - DNA, 714 bp, Homo sapiens
atgagtgtgctcactcaggtcctggcgttgctgctgctgtggcttacaggtacgcgttgcgacatcgccctgacccagcccgccagcgtgagcggcagccctggccagagcatcaccatcagctgcaccggcaccagcagcgacgtgggcgacatcaacgacgtgagctggtatcagcagcaccccggcaaggcccccaagctgatgatctacgacgtgaacaaccggcccagcggcgtgagcaaccggttcagcggcagcaagagcggcaacaccgccagcctgaccatcagcggcctccaggccgaggacgaggccgactactactgccagagctacgccggcagctacctgagcgaggtgttcggcggagggaccaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 587 - DNA, 714 bp, Homo sapiens; identical to SEQ ID NO: 584

SEQ ID NO: 588 - DNA, 714 bp, Homo sapiens; identical to SEQ ID NO: 584

SEQ ID NO: 589 - DNA, 714 bp, Homo sapiens; identical to SEQ ID NO: 584

SEQ ID NO: 590 - DNA, 714 bp, Homo sapiens; identical to SEQ ID NO: 584

SEQ ID NO: 591 - DNA, 714 bp, Homo sapiens
atgagtgtgctcactcaggtcctggcgttgctgctgctgtggcttacaggtacgcgttgcgacatcgccctgacccagcccgccagcgtgagcggcagccctggccagagcatcaccatcagctgcaccggcaccagcagcgacgtgggcgacatcaacgacgtgagctggtatcagcagcaccccggcaaggcccccaagctgatgatctacgacgtgaacaaccggcccagcggcgtgagcaaccggttcagcggcagcaagagcggcaacaccgccagcctgaccatcagcggcctccaggccgaggacgaggccgactactactgcagcacctacgacggccctggcctgagcgaggtgttcggcggagggaccaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 592 - DNA, 714 bp, Homo sapiens; identical to SEQ ID NO: 591

SEQ ID NO: 593 - DNA, 714 bp, Homo sapiens; identical to SEQ ID NO: 591

SEQ ID NO: 594 - protein, 213 aa, Homo sapiens; identical to SEQ ID NO: 397

SEQ ID NO: 595 - protein, 14 aa, Homo sapiens
ARLLNAIGRGKWWR

SEQ ID NO: 596 - protein, 15 aa, Homo sapiens
RLVASCKCKRLTRFH

SEQ ID NO: 597 - protein, 13 aa, Homo sapiens
GGGSGGGGSGGGG

SEQ ID NO: 598 - protein, 19 aa, Homo sapiens
GGGGSGGGGSGGGGSGGGG

SEQ ID NO: 599 - DNA, 21 bp, Artificial
  siRNA
taaattatcataaagtcctaa

SEQ ID NO: 600 - DNA, 21 bp, Artificial
  siRNA
aggactttatgataatttatt

SEQ ID NO: 601 - DNA, 21 bp, Artificial
  siRNA
atagtggttaaataactccag

SEQ ID NO: 602 - DNA, 21 bp, Artificial
  siRNA
ggagttatttaaccactattt

SEQ ID NO: 603 - DNA, 21 bp, Artificial
  siRNA
taaattctcgtgatgtgccat

SEQ ID NO: 604 - DNA, 21 bp, Artificial
  siRNA
ggcacatcacgagaatttatt

SEQ ID NO: 605 - DNA, 21 bp, Artificial
  siRNA
tttcttatagcacagctggtt

SEQ ID NO: 606 - DNA, 21 bp, Artificial
  siRNA
ccagctgtgctataagaaatt

SEQ ID NO: 607 - DNA, 21 bp, Artificial
  siRNA
tagacctttccatccacgctg

SEQ ID NO: 608 - DNA, 21 bp, Artificial
  siRNA
gcgtggatggaaaggtctatt

SEQ ID NO: 609 - DNA, 29 bp, Artificial
  siRNA
atgcagctcccactggccctgtgtcttgt

SEQ ID NO: 610 - DNA, 30 bp, Artificial
  siRNA
aatcaggccgagctggagaacgcctactag

SEQ ID NO: 611 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
EVQLVESGGGLVQPGGSLRLSCAASGIPFSXXXXXWFRQAPGKQRDSVAXXXXXRFTISRDNAKNTVYLQMNSLKPEDTAVYRCYFXXXXXWGQGTQVTVSS

SEQ ID NO: 612 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
QVKLEESGGGLVQAGGSLRLSCVGSGRTFSXXXXXWFRLAPGKEREFVAXXXXXRFTISRDTASNRGYLHMNNLTPEDTAVYYCAAXXXXXWGQGTQVTVSS

SEQ ID NO: 613 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
AVQLVDSGGGLVQAGDSLKLSCALTGGAFTXXXXXWFRQTPGREREFVAXXXXXRFTISRDNAKNMVYLRMNSLIPEDAAVYSCAAXXXXXWGQGTLVTVSS

SEQ ID NO: 614 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
QVQLVESGGGLVEAGGSLRLSCTASESPFRXXXXXWFRQTSGQEREFVAXXXXXRFTISRDDAKNTVWLHGSTLKPEDTAVYYCAAXXXXXWGQGTQVTVSS

SEQ ID NO: 615 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
AVQLVESGGGLVQGGGSLRLACAASERIFDXXXXXWYRQGPGNERELVAXXXXXRFTISMDYTKQTVYLHMNSLRPEDTGLYYCKIXXXXXWGQGTQVTVSS

SEQ ID NO: 616 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
DVKFVESGGGLVQAGGSLRLSCVASGFNFDXXXXXWFRQAPGKEREEVAXXXXXRFTISSEKDKNSVYLQMNSLKPEDTALYICAGXXXXXWGRGTQVTVSS

SEQ ID NO: 617 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
  misc_feature (87)..(91): CDR
QVRLAESGGGLVQSGGSLRLSCVASGSTYTXXXXXWYRQYPGKQRALVAXXXXXRFTIARDSTKDTFCLQMNNLKPEDTAVYYCYAXXXXXWGQGTQVTVSS

SEQ ID NO: 618 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
EVQLVESGGGLVQAGGSLRLSCAASGFTSDXXXXXWFRQAPGKPREGVSXXXXXRFTISTDNAKNTVHLLMNRVNAEDTALYYCAVXXXXXWGRGTRVTVSS

SEQ ID NO: 619 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
QVQLVESGGGLVQPGGSLRLSCQASGDISTXXXXXWYRQVPGKLREFVAXXXXXRFTISGDNAKRAIYLQMNNLKPDDTAVYYCNRXXXXXWGQGTQVTVSP

SEQ ID NO: 620 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
QVPVVESGGGLVQAGDSLRLFCAVPSFTSTXXXXXWFRQAPGKEREFVAXXXXXRFTISRNATKNTLTLRMDSLKPEDTAVYYCAAXXXXXWGQGTQVTVSS

SEQ ID NO: 621 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
EVQLVESGGGLVQAGDSLRLFCTVSGGTASXXXXXWFRQAPGEKREFVAXXXXXRFTIARENAGNMVYLQMNNLKPDDTALYTCAAXXXXXWGRGTQVTVSS

SEQ ID NO: 622 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
AVQLVESGGDSVQPGDSQTLSCAASGRTNSXXXXXWFRQAPGKERVFLAXXXXXRFTISRDSAKNMMYLQMNNLKPQDTAVYYCAAXXXXXWGQGTQVTVSS

SEQ ID NO: 623 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
AVQLVESGGGLVQAGGSLRLSCVVSGLTSSXXXXXWFRQTPWQERDFVAXXXXXRFTISRDNYKDTVLLEMNFLKPEDTAIYYCAAXXXXXWGQGTQVTVSS

SEQ ID NO: 624 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
  misc_feature (87)..(91): CDR
AVQLVESGGGLVQAGASLRLSCATSTRTLDXXXXXWFRQAPGRDREFVAXXXXXRFTVSRDSAENTVALQMNSLKPEDTAVYYCAAXXXXXWGQGTRVTVSS

SEQ ID NO: 625 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
QVQLVESGGGLVQPGGSLRLSCTVSRLTAHXXXXXWFRQAPGKEREAVSXXXXXRFTISRDYAGNTAFLQMDSLKPEDTGVYYCATXXXXXWGQGTQVTVSS

SEQ ID NO: 626 - protein, 102 aa, Artificial Sequence
  KERE-class Nanobody
  misc_feature (1)..(102): Xaa is any amino acid
  misc_feature (31)..(35): CDR
  misc_feature (50)..(54): CDR
  misc_feature (87)..(91): CDR
EVQLVESGGELVQAGGSLKLSCTASGRNFVXXXXXWFRRAPGKEREFVAXXXXXRFTVSRDNGKNTAYLRMNSLKPEDTADYYCAVXXXXXLGSGTQVTVSS

SEQ ID NO: 627 - protein, 102 aa, Artificial Sequence
  GLEW-class Nanobody
  misc_feature (1)..(102): Xaa is any amino acid
  misc_feature (31)..(35): CDR
  misc_feature (50)..(54): CDR
  misc_feature (87)..(91): CDR
AVQLVESGGGLVQPGGSLRLSCAASGFTFSXXXXXWVRQAPGKVLEWVSXXXXXRFTISRDNAKNTLYLQMNSLKPEDTAVYYCVKXXXXXGSQGTQVTVSS

SEQ ID NO: 628 - protein, 102 aa, Artificial Sequence
  GLEW-class Nanobody
  misc_feature (1)..(102): Xaa is any amino acid
  misc_feature (31)..(35): CDR
  misc_feature (50)..(54): CDR
  misc_feature (87)..(91): CDR
EVQLVESGGGLVQPGGSLRLSCVCVSSGCTXXXXXWVRQAPGKAEEWVSXXXXXRFKISRDNAKKTLYLQMNSLGPEDTAMYYCQRXXXXXRGQGTQVTVSS

SEQ ID NO: 629 - protein, 102 aa, Artificial Sequence
  GLEW-class Nanobody
  misc_feature (1)..(102): Xaa is any amino acid
  misc_feature (31)..(35): CDR
  misc_feature (50)..(54): CDR
  misc_feature (87)..(91): CDR
EVQLVESGGGLALPGGSLTLSCVFSGSTFSXXXXXWVRHTPGKAEEWVSXXXXXRFTISRDNAKNTLYLEMNSLSPEDTAMYYCGRXXXXXRSKGIQVTVSS

SEQ ID NO: 630 - protein, 102 aa, Artificial Sequence
  P,R,S 103-class Nanobody
  misc_feature (1)..(102): Xaa is any amino acid
  misc_feature (31)..(35): CDR
  misc_feature (50)..(54): CDR
  misc_feature (87)..(91): CDR
AVQLVESGGGLVQAGGSLRLSCAASGRTFSXXXXXWFRQAPGKEREFVAXXXXXRFTISRDNAKNTVYLQMNSLKPEDTAVYYCAAXXXXXRGQGTQVTVSS

SEQ ID NO: 631 - protein, 102 aa, Artificial Sequence
  P,R,S 103-class Nanobody
  misc_feature (1)..(102): Xaa is any amino acid
  misc_feature (31)..(35): CDR
  misc_feature (50)..(54): CDR
  misc_feature (87)..(91): CDR
DVQLVESGGDLVQPGGSLRLSCAASGFSFDXXXXXWLRQTPGKGLEWVGXXXXXRFTISRDNAKNMLYLHLNNLKSEDTAVYYCRRXXXXXLGQGTQVTVSS

SEQ ID NO: 632 - protein, 102 aa, Artificial Sequence; identical to SEQ ID NO: 628
  P,R,S 103-class Nanobody
  misc_feature (1)..(102): Xaa is any amino acid
  misc_feature (31)..(35): CDR
  misc_feature (50)..(54): CDR
  misc_feature (87)..(91): CDR

SEQ ID NO: 633 - protein, 30 aa, Artificial Sequence
  KERE-class Nanobody FW1 sequence
QVQRVESGGGLVQAGGSLRLSCAASGRTSS

SEQ ID NO: 634 - protein, 30 aa, Artificial Sequence
  KERE-class Nanobody FW1 sequence
QVQLVESGGGLVQTGDSLSLSCSASGRTFS

SEQ ID NO: 635 - protein, 30 aa, Artificial Sequence
  KERE-class Nanobody FW1 sequence
QVKLEESGGGLVQAGDSLRLSCAATGRAFG

SEQ ID NO: 636 - protein, 30 aa, Artificial Sequence
  KERE-class Nanobody FW1 sequence
AVQLVESGGGLVQPGESLGLSCVASGRDFV

SEQ ID NO: 637 - protein, 30 aa, Artificial Sequence
  KERE-class Nanobody FW1 sequence
EVQLVESGGGLVQAGGSLRLSCEVLGRTAG

SEQ ID NO: 638 - protein, 30 aa, Artificial Sequence
  KERE-class Nanobody FW1 sequence
QVQLVESGGGWVQPGGSLRLSCAASETILS

SEQ ID NO: 639 - protein, 30 aa, Artificial Sequence
  KERE-class Nanobody FW1 sequence
QVQLVESGGGTVQPGGSLNLSCVASGNTFN

SEQ ID NO: 640 - protein, 30 aa, Artificial Sequence
  KERE-class Nanobody FW1 sequence
EVQLVESGGGLAQPGGSLQLSCSAPGFTLD

SEQ ID NO: 641 - protein, 30 aa, Artificial Sequence
  KERE-class Nanobody FW1 sequence
AQELEESGGGLVQAGGSLRLSCAASGRTFN

SEQ ID NO: 642 - protein, 22 aa, Artificial Sequence
  KERE-class Nanobody FW1 sequence
VESGGGLVQPGGSLRLSCAASG

SEQ ID NO: 643 - protein, 22 aa, Artificial Sequence
  KERE-class Nanobody FW1 sequence
VDSGGGLVQAGDSLKLSCALTG

SEQ ID NO: 644 - protein, 22 aa, Artificial Sequence
  KERE-class Nanobody FW1 sequence
VDSGGGLVQAGDSLRLSCAASG

SEQ ID NO: 645 - protein, 22 aa, Artificial Sequence
  KERE-class Nanobody FW1 sequence
VDSGGGLVEAGGSLRLSCQVSE

SEQ ID NO: 646 - protein, 22 aa, Artificial Sequence
  KERE-class Nanobody FW1 sequence
QDSGGGSVQAGGSLKLSCAASG

SEQ ID NO: 647 - protein, 22 aa, Artificial Sequence
  KERE-class Nanobody FW1 sequence
VQSGGRLVQAGDSLRLSCAASE

SEQ ID NO: 648 - protein, 22 aa, Artificial Sequence
  KERE-class Nanobody FW1 sequence
VESGGTLVQSGDSLKLSCASST

SEQ ID NO: 649 - protein, 22 aa, Artificial Sequence
  KERE-class Nanobody FW1 sequence
MESGGDSVQSGGSLTLSCVASG

SEQ ID NO: 650 - protein, 22 aa, Artificial Sequence
  KERE-class Nanobody FW1 sequence
QASGGGLVQAGGSLRLSCSASV

SEQ ID NO: 651 - protein, 14 aa, Artificial Sequence
  KERE-class Nanobody FW2 sequence
WFRQAPGKEREFVA

SEQ ID NO: 652 - protein, 14 aa, Artificial Sequence
  KERE-class Nanobody FW2 sequence
WFRQTPGREREFVA

SEQ ID NO: 653 - protein, 14 aa, Artificial Sequence
  KERE-class Nanobody FW2 sequence
WYRQAPGKQREMVA

SEQ ID NO: 654 - protein, 14 aa, Artificial Sequence
  KERE-class Nanobody FW2 sequence
WYRQGPGKQRELVA

SEQ ID NO: 655 - protein, 14 aa, Artificial Sequence
  KERE-class Nanobody FW2 sequence
WIRQAPGKEREGVS

SEQ ID NO: 656 - protein, 14 aa, Artificial Sequence
  KERE-class Nanobody FW2 sequence
WFREAPGKEREGIS

SEQ ID NO: 657 - protein, 14 aa, Artificial Sequence
  KERE-class Nanobody FW2 sequence
WYRQAPGKERDLVA

SEQ ID NO: 658 - protein, 14 aa, Artificial Sequence
  KERE-class Nanobody FW2 sequence
WFRQAPGKQREEVS

SEQ ID NO: 659 - protein, 14 aa, Artificial Sequence
  KERE-class Nanobody FW2 sequence
WFRQPPGKVREFVG

SEQ ID NO: 660 - protein, 32 aa, Artificial Sequence
  KERE-class Nanobody FW3 sequence
RFTISRDNAKNTVYLQMNSLKPEDTAVYRCYF

SEQ ID NO: 661 - protein, 32 aa, Artificial Sequence
  KERE-class Nanobody FW3 sequence
RFAISRDNNKNTGYLQMNSLEPEDTAVYYCAA

SEQ ID NO: 662 - protein, 32 aa, Artificial Sequence
  KERE-class Nanobody FW3 sequence
RFTVARNNAKNTVNLEMNSLKPEDTAVYYCAA

SEQ ID NO: 663 - protein, 32 aa, Artificial Sequence
  KERE-class Nanobody FW3 sequence
RFTISRDIAKNTVDLLMNNLEPEDTAVYYCAA

SEQ ID NO: 664 - protein, 32 aa, Artificial Sequence
  KERE-class Nanobody FW3 sequence
RLTISRDNAVDTMYLQMNSLKPEDTAVYYCAA

SEQ ID NO: 665 - protein, 32 aa, Artificial Sequence
  KERE-class Nanobody FW3 sequence
RFTISRDNAKNTVYLQMDNVKPEDTAIYYCAA

SEQ ID NO: 666 - protein, 32 aa, Artificial Sequence
  KERE-class Nanobody FW3 sequence
RFTISKDSGKNTVYLQMTSLKPEDTAVYYCAT

SEQ ID NO: 667 - protein, 32 aa, Artificial Sequence
  KERE-class Nanobody FW3 sequence
RFTISRDSAKNMMYLQMNNLKPQDTAVYYCAA

SEQ ID NO: 668 - protein, 32 aa, Artificial Sequence
  KERE-class Nanobody FW3 sequence
RFTISRENDKSTVYLQLNSLKPEDTAVYYCAA

SEQ ID NO: 669 - protein, 32 aa, Artificial Sequence
  KERE-class Nanobody FW3 sequence
RFTISRDYAGNTAYLQMNSLKPEDTGVYYCAT

SEQ ID NO: 670 - protein, 11 aa, Artificial Sequence
  KERE-class Nanobody FW4 sequence
WGQGTQVTVSS

SEQ ID NO: 671 - protein, 11 aa, Artificial Sequence
  KERE-class Nanobody FW4 sequence
WGKGTLVTVSS

SEQ ID NO: 672 - protein, 11 aa, Artificial Sequence
  KERE-class Nanobody FW4 sequence
RGQGTRVTVSS

SEQ ID NO: 673 - protein, 11 aa, Artificial Sequence
  KERE-class Nanobody FW4 sequence
WGLGTQVTISS

SEQ ID NO: 674 - protein, 30 aa, Artificial Sequence
  GLEW-class Nanobody FW1 sequence
QVQLVESGGGLVQPGGSLRLSCAASGFTFS

SEQ ID NO: 675 - protein, 30 aa, Artificial Sequence
  GLEW-class Nanobody FW1 sequence
EVHLVESGGGLVRPGGSLRLSCAAFGFIFK

SEQ ID NO: 676 - protein, 30 aa, Artificial Sequence
  GLEW-class Nanobody FW1 sequence
QVKLEESGGGLAQPGGSLRLSCVASGFTFS

SEQ ID NO: 677 - protein, 30 aa, Artificial Sequence
  GLEW-class Nanobody FW1 sequence
EVQLVESGGGLVQPGGSLRLSCVCVSSGCT

SEQ ID NO: 678 - protein, 30 aa, Artificial Sequence
  GLEW-class Nanobody FW1 sequence
EVQLVESGGGLALPGGSLTLSCVFSGSTFS

SEQ ID NO: 679 - protein, 22 aa, Artificial Sequence
  GLEW-class Nanobody FW1 sequence
VESGGGLVQPGGSLRLSCAASG

SEQ ID NO: 680 - protein, 22 aa, Artificial Sequence
  GLEW-class Nanobody FW1 sequence
EESGGGLAQPGGSLRLSCVASG

SEQ ID NO: 681 - protein, 22 aa, Artificial Sequence
  GLEW-class Nanobody FW1 sequence
VESGGGLALPGGSLTLSCVFSG

SEQ ID NO: 682 - protein, 14 aa, Artificial Sequence
  GLEW-class Nanobody FW2 sequence
WVRQAPGKVLEWVS

SEQ ID NO: 683 - protein, 14 aa, Artificial Sequence
  GLEW-class Nanobody FW2 sequence
WVRRPPGKGLEWVS

SEQ ID NO: 684 - protein, 14 aa, Artificial Sequence
  GLEW-class Nanobody FW2 sequence
WVRQAPGMGLEWVS

SEQ ID NO: 685 - protein, 14 aa, Artificial Sequence
  GLEW-class Nanobody FW2 sequence
WVRQAPGKEPEWVS

SEQ ID NO: 686 - protein, 14 aa, Artificial Sequence
  GLEW-class Nanobody FW2 sequence
WVRQAPGKDQEWVS

SEQ ID NO: 687 - protein, 14 aa, Artificial Sequence
  GLEW-class Nanobody FW2 sequence
WVRQAPGKAEEWVS

SEQ ID NO: 688 - protein, 14 aa, Artificial Sequence
  GLEW-class Nanobody FW2 sequence
WVRQAPGKGLEWVA

SEQ ID NO: 689 - protein, 14 aa, Artificial Sequence
  GLEW-class Nanobody FW2 sequence
WVRQAPGRATEWVS

SEQ ID NO: 690 - protein, 32 aa, Artificial Sequence
  GLEW-class Nanobody FW3 sequence
RFTISRDNAKNTLYLQMNSLKPEDTAVYYCVK

SEQ ID NO: 691 - protein, 32 aa, Artificial Sequence
  GLEW-class Nanobody FW3 sequence
RFTISRDNARNTLYLQMDSLIPEDTALYYCAR

SEQ ID NO: 692 - protein, 32 aa, Artificial Sequence
  GLEW-class Nanobody FW3 sequence
RFTSSRDNAKSTLYLQMNDLKPEDTALYYCAR

SEQ ID NO: 693 - protein, 32 aa, Artificial Sequence
  GLEW-class Nanobody FW3 sequence
RFIISRDNAKNTLYLQMNSLGPEDTAMYYCQR

SEQ ID NO: 694 - protein, 32 aa, Artificial Sequence
  GLEW-class Nanobody FW3 sequence
RFTASRDNAKNTLYLQMNSLKSEDTARYYCAR

SEQ ID NO: 695 - protein, 32 aa, Artificial Sequence
  GLEW-class Nanobody FW3 sequence
RFTISRDNAKNTLYLQMDDLQSEDTAMYYCGR

SEQ ID NO: 696 - protein, 11 aa, Artificial Sequence
  GLEW-class Nanobody FW4 sequence
GSQGTQVTVSS

SEQ ID NO: 697 - protein, 11 aa, Artificial Sequence
  GLEW-class Nanobody FW4 sequence
LRGGTQVTVSS

SEQ ID NO: 698 - protein, 11 aa, Artificial Sequence
  GLEW-class Nanobody FW4 sequence
RGQGTLVTVSS

SEQ ID NO: 699 - protein, 11 aa, Artificial Sequence
  GLEW-class Nanobody FW4 sequence
RSRGIQVTVSS

SEQ ID NO: 700 - protein, 11 aa, Artificial Sequence
  GLEW-class Nanobody FW4 sequence
WGKGTQVTVSS

SEQ ID NO: 701 - protein, 11 aa, Artificial Sequence
  GLEW-class Nanobody FW4 sequence
WGQGTQVTVSS

SEQ ID NO: 702 - protein, 30 aa, Artificial Sequence
  P,R,S 103-class Nanobody FW1 sequence
AVQLVESGGGLVQAGGSLRLSCAASGRTFS

SEQ ID NO: 703 - protein, 30 aa, Artificial Sequence
  P,R,S 103-class Nanobody FW1 sequence
QVQLQESGGGMVQPGGSLRLSCAASGFDFG

SEQ ID NO: 704 - protein, 30 aa, Artificial Sequence; identical to SEQ ID NO: 675
  P,R,S 103-class Nanobody FW1 sequence

SEQ ID NO: 705 - protein, 30 aa, Artificial Sequence
  P,R,S 103-class Nanobody FW1 sequence
QVQLAESGGGLVQPGGSLKLSCAASRTIVS

SEQ ID NO: 706 - protein, 30 aa, Artificial Sequence
  P,R,S 103-class Nanobody FW1 sequence
QEHLVESGGGLVDIGGSLRLSCAASERIFS

SEQ ID NO: 707 - protein, 30 aa, Artificial Sequence; identical to SEQ ID NO: 676
  P,R,S 103-class Nanobody FW1 sequence

SEQ ID NO: 708 - protein, 30 aa, Artificial Sequence; identical to SEQ ID NO: 677
  P,R,S 103-class Nanobody FW1 sequence

SEQ ID NO: 709 - protein, 30 aa, Artificial Sequence; identical to SEQ ID NO: 678
  P,R,S 103-class Nanobody FW1 sequence

SEQ ID NO: 710 - protein, 22 aa, Artificial Sequence
  P,R,S 103-class Nanobody FW1 sequence
VESGGGLVQAGGSLRLSCAASG

SEQ ID NO: 711 - protein, 22 aa, Artificial Sequence
  P,R,S 103-class Nanobody FW1 sequence
AESGGGLVQPGGSLKLSCAASR

SEQ ID NO: 712 - protein, 14 aa, Artificial Sequence
  P,R,S 103-class Nanobody FW2 sequence
WFRQAPGKEREFVA

SEQ ID NO: 713 - protein, 14 aa, Artificial Sequence
  P,R,S 103-class Nanobody FW2 sequence
WVRQAPGKVLEWVS

SEQ ID NO: 714 - protein, 14 aa, Artificial Sequence
  P,R,S 103-class Nanobody FW2 sequence
WVRRPPGKGLEWVS

SEQ ID NO: 715 - protein, 14 aa, Artificial Sequence
  P,R,S 103-class Nanobody FW2 sequence
WIRQAPGKEREGVS

SEQ ID NO: 716 - protein, 14 aa, Artificial Sequence
  P,R,S 103-class Nanobody FW2 sequence
WVRQYPGKEPEWVS

SEQ ID NO: 717 - protein, 14 aa, Artificial Sequence
  P,R,S 103-class Nanobody FW2 sequence
WFRQPPGKEHEFVA

SEQ ID NO: 718 - protein, 14 aa, Artificial Sequence
  P,R,S 103-class Nanobody FW2 sequence
WYRQAPGKRTELVA

SEQ ID NO: 719 - protein, 14 aa, Artificial Sequence
  P,R,S 103-class Nanobody FW2 sequence
WLRQAPGQGLEWVS

SEQ ID NO: 720 - protein, 14 aa, Artificial Sequence
  P,R,S 103-class Nanobody FW2 sequence
WLRQTPGKGLEWVG

SEQ ID NO: 721 - protein, 14 aa, Artificial Sequence
  P,R,S 103-class Nanobody FW2 sequence
WVRQAPGKAEEFVS

SEQ ID NO: 722 - protein, 32 aa, Artificial Sequence
  P,R,S 103-class Nanobody FW3 sequence
RFTISRDNAKNTVYLQMNSLKPEDTAVYYCAA

SEQ ID NO: 723 - protein, 32 aa, Artificial Sequence; identical to SEQ ID NO: 691
  P,R,S 103-class Nanobody FW3 sequence

SEQ ID NO: 724 - protein, 32 aa, Artificial Sequence
  P,R,S 103-class Nanobody FW3 sequence
RFTISRDNAKNEMYLQMNNLKTEDTGVYWCGA

SEQ ID NO: 725 - protein, 32 aa, Artificial Sequence
  P,R,S 103-class Nanobody FW3 sequence
RFTISSDSNRNMIYLQMNNLKPEDTAVYYCAA

SEQ ID NO: 726 - protein, 32 aa, Artificial Sequence
  P,R,S 103-class Nanobody FW3 sequence
RFTISRDNAKNMLYLHLNNLKSEDTAVYYCRR

SEQ ID NO: 727 - protein, 32 aa, Artificial Sequence
  P,R,S 103-class Nanobody FW3 sequence
RFTISRDNAKKTVYLRLNSLNPEDTAVYSCNL

SEQ ID NO: 728 - protein, 32 aa, Artificial Sequence
  P,R,S 103-class Nanobody FW3 sequence
RFKISRDNAKKTLYLQMNSLGPEDTAMYYCQR

SEQ ID NO: 729 - protein, 32 aa, Artificial Sequence
  P,R,S 103-class Nanobody FW3 sequence
RFTVSRDNGKNTAYLRMNSLKPEDTADYYCAV

SEQ ID NO: 730 - protein, 11 aa, Artificial Sequence
  P,R,S 103-class Nanobody FW4 sequence
RGQGTQVTVSS

SEQ ID NO: 731 - protein, 11 aa, Artificial Sequence
  P,R,S 103-class Nanobody FW4 sequence
LRGGTQVTVSS

SEQ ID NO: 732 - protein, 11 aa, Artificial Sequence
  P,R,S 103-class Nanobody FW4 sequence
GNKGTLVTVSS

SEQ ID NO: 733 - protein, 11 aa, Artificial Sequence
  P,R,S 103-class Nanobody FW4 sequence
SSPGTQVTVSS

SEQ ID NO: 734 - protein, 11 aa, Artificial Sequence
  P,R,S 103-class Nanobody FW4 sequence
SSQGTLVTVSS

SEQ ID NO: 735 - protein, 11 aa, Artificial Sequence
  P,R,S 103-class Nanobody FW4 sequence
RSRGIQVTVSS

SEQ ID NO: 736 - protein, 30 aa, Artificial Sequence
  FR1 sequence
EVQLVESGGGLVQPGGSLRLSCAASGSIFS

SEQ ID NO: 737 - protein, 30 aa, Artificial Sequence
  FR1 sequence
EVQLVESGGGLVQAGDSLRLSCTATGRTSS

SEQ ID NO: 738 - protein, 30 aa, Artificial Sequence
  FR1 sequence
EVQLVESGGGLVQAGGSLRLSCATSGFTFS

SEQ ID NO: 739 - protein, 30 aa, Artificial Sequence
  FR1 sequence
KVQLVESGGGLVQAGGSLRLSCAASGRTFS

SEQ ID NO: 740 - protein, 30 aa, Artificial Sequence
  FR1 sequence
EVQLVESGGGLVQAGDSLRLSCAATGRTSS

SEQ ID NO: 741 - protein, 30 aa, Artificial Sequence
  FR1 sequence
EVQLVESGGGLVQAGGSLRLSCVASGRTLR

SEQ ID NO: 742 - protein, 30 aa, Artificial Sequence
  FR1 sequence
EVQLVESGGGLVQAGGSLRLTCAASGRTFS

SEQ ID NO: 743 - protein, 30 aa, Artificial Sequence
  FR1 sequence
EVQLVESGGGLVQAGGSLRLSCAASGLTFN

SEQ ID NO: 744 - protein, 30 aa, Artificial Sequence; identical to SEQ ID NO: 740
  FR1 sequence

SEQ ID NO: 745 - protein, 5 aa, Artificial Sequence
  CDR sequence
DNVMG

SEQ ID NO: 746 - protein, 5 aa, Artificial Sequence
  CDR sequence
IYNMD

SEQ ID NO: 747 - protein, 5 aa, Artificial Sequence
  CDR sequence
RFDMS

SEQ ID NO: 748 - protein, 5 aa, Artificial Sequence
  CDR sequence
SYFMG

SEQ ID NO: 749 - protein, 5 aa, Artificial Sequence
  CDR sequence
IYNMD

SEQ ID NO: 750 - protein, 5 aa, Artificial Sequence
  CDR sequence
RYVTG

SEQ ID NO: 751 - protein, 5 aa, Artificial Sequence
  CDR sequence
SFVIG

SEQ ID NO: 752 - protein, 5 aa, Artificial Sequence
  CDR sequence
QYTIT

SEQ ID NO: 753 - protein, 5 aa, Artificial Sequence
  CDR sequence
IYNMD

SEQ ID NO: 754 - protein, 14 aa, Artificial Sequence
  FR2 sequence
WYRQAPGKQRELVA

SEQ ID NO: 755 - protein, 14 aa, Artificial Sequence
  FR2 sequence
WFRQTPGKERELIA

SEQ ID NO: 756 - protein, 14 aa, Artificial Sequence
  FR2 sequence
WFRQAPGKQREFIA

SEQ ID NO: 757 - protein, 14 aa, Artificial Sequence
  FR2 sequence
WFRQAPGKEREVVA

SEQ ID NO: 758 - protein, 14 aa, Artificial Sequence
  FR2 sequence
WFLQAPGKERELIA

SEQ ID NO: 759 - protein, 14 aa, Artificial Sequence
  FR2 sequence
WFRQAPGKEREVVA

SEQ ID NO: 760 - protein, 14 aa, Artificial Sequence
  FR2 sequence
WFRQAPGKQREVVA

SEQ ID NO: 761 - protein, 14 aa, Artificial Sequence
  FR2 sequence
WFRQAPGKEREFVA

SEQ ID NO: 762 - protein, 14 aa, Artificial Sequence
  FR2 sequence
WFRQGSGKGRELIA

SEQ ID NO: 763 - protein, 16 aa, Artificial Sequence
  CDR sequence
TIWSSGHTNYADSVKG

SEQ ID NO: 764 - protein, 17 aa, Artificial Sequence
  CDR sequence
RLWWRSGSTYYADSVKG

SEQ ID NO: 765 - protein, 16 aa, Artificial Sequence
  CDR sequence
TIFSGGDTDYIDSVKG

SEQ ID NO: 766 - protein, 17 aa, Artificial Sequence
  CDR sequence
TIRWSDGSTYYEDSVKG

SEQ ID NO: 767 - protein, 17 aa, Artificial Sequence
  CDR sequence
RIWWRSGATYYADSVKG

SEQ ID NO: 768 - protein, 17 aa, Artificial Sequence
  CDR sequence
SISWSGESTYYADSVKG

SEQ ID NO: 769 - protein, 16 aa, Artificial Sequence
  CDR sequence
SITSGGSTYYEDSGKG

SEQ ID NO: 770 - protein, 17 aa, Artificial Sequence
  CDR sequence
AVSWSGSSESVSNSVKG

SEQ ID NO: 771 - protein, 17 aa, Artificial Sequence
  CDR sequence
RIWWRSGETYYADSVKG

SEQ ID NO: 772 - protein, 32 aa, Artificial Sequence
  FR3 sequence
RFTISRDNAKNTVYLQMNSLKPEDTAVYYCNL

SEQ ID NO: 773 - protein, 32 aa, Artificial Sequence
  FR3 sequence
RFTISRDNAKNTVYLQMNSLKPEDTSVYICTA

SEQ ID NO: 774 - protein, 32 aa, Artificial Sequence
  FR3 sequence
RFTISRDNAKNTVYLQMNSLKPEDTAVYYCCP

SEQ ID NO: 775 - protein, 32 aa, Artificial Sequence; identical to SEQ ID NO: 722
  FR3 sequence

SEQ ID NO: 776 - protein, 32 aa, Artificial Sequence
  FR3 sequence
RFTISRGNAKNTVYLQMNSLKPEDTGVYHCTA

SEQ ID NO: 777 - protein, 32 aa, Artificial Sequence
  FR3 sequence
RFAISRDNAKNAVYLQMNSLNLEDTGVYYCAE

SEQ ID NO: 778 - protein, 32 aa, Artificial Sequence
  FR3 sequence
RFTISRDNAKNRVYLQMNSLRPEDTAVYYCAA

SEQ ID NO: 779 - protein, 32 aa, Artificial Sequence
  FR3 sequence
RFTISRDNAKNTAYLAMNSLKPEDTAVYYCAA

SEQ ID NO: 780 - protein, 32 aa, Artificial Sequence
  FR3 sequence
RFTISRDNAKNTVYLQMNSLKPEDTNVYHCAA

SEQ ID NO: 781 - protein, 12 aa, Artificial Sequence
  CDR sequence
GTIVTGTWRSDY

SEQ ID NO: 782 - protein, 10 aa, Artificial Sequence
  CDR sequence
GDTGGAAYGY

SEQ ID NO: 783 - protein, 6 aa, Artificial Sequence
  CDR sequence
LGIEYA

SEQ ID NO: 784 - protein, 9 aa, Artificial Sequence
  CDR sequence
AKGIGVYGY

SEQ ID NO: 785 - protein, 10 aa, Artificial Sequence
  CDR sequence
GVTGGAAYGY

SEQ ID NO: 786 - protein, 9 aa, Artificial Sequence
  CDR sequence
AELPGTYDY

SEQ ID NO: 787 - protein, 9 aa, Artificial Sequence
  CDR sequence
AEPAGVYDV

SEQ ID NO: 788 - protein, 15 aa, Artificial Sequence
  CDR sequence
DRRGLASTRAADYDY

SEQ ID NO: 789 - protein, 10 aa, Artificial Sequence
  CDR sequence
GDTGGASYGY

SEQ ID NO: 790 - protein, 11 aa, Artificial Sequence
  FR4 sequence
WGQGTQVTVSS

SEQ ID NO: 791 - protein, 11 aa, Artificial Sequence
  FR4 sequence
WGQGTQVTVSS

SEQ ID NO: 792 - protein, 11 aa, Artificial Sequence
  FR4 sequence
WGQGTQVTVSS

SEQ ID NO: 793 - protein, 11 aa, Artificial Sequence
  FR4 sequence
WGQGTQVTVSS

SEQ ID NO: 794 - protein, 11 aa, Artificial Sequence
  FR4 sequence
WGQGTQVTVSS

SEQ ID NO: 795 - protein, 11 aa, Artificial Sequence
  FR4 sequence
WGQGTQVTVSS

SEQ ID NO: 796 - protein, 11 aa, Artificial Sequence
  FR4 sequence
WGQGTQVTVSS

SEQ ID NO: 797 - protein, 11 aa, Artificial Sequence
  FR4 sequence
WGQGTQVTVSS

SEQ ID NO: 798 - protein, 11 aa, Artificial Sequence
  FR4 sequence
WGQGTQVTVSS

SEQ ID NO: 799 - protein, 120 aa, Artificial Sequence
  Nanobody
EVQLVESGGGLVQPGGSLRLSCAASGSIFSDNVMGWYRQAPGKQRELVATIWSSGHTNYADSVKGRFTISRDNAKNTVYLQMNSLKPEDTAVYYCNLGTIVTGTWRSDYWGQGTQVTVSS

SEQ ID NO: 800 - protein, 119 aa, Artificial Sequence
  Nanobody
EVQLVESGGGLVQAGDSLRLSCTATGRTSSIYNMDWFRQTPGKERELIARLWWRSGSTYYADSVKGRFTISRDNAKNTVYLQMNSLKPEDTSVYICTAGDTGGAAYGYWGQGTQVTVSS

SEQ ID NO: 801 - protein, 114 aa, Artificial Sequence
  Nanobody
EVQLVESGGGLVQAGGSLRLSCATSGFTFSRFDMSWFRQAPGKQREFIATIFSGGDTDYIDSVKGRFTISRDNAKNTVYLQMNSLKPEDTAVYYCCPLGIEYAWGQGTQVTVSS

SEQ ID NO: 802 - protein, 118 aa, Artificial Sequence
  Nanobody
KVQLVESGGGLVQAGGSLRLSCAASGRTFSSYFMGWFRQAPGKEREVVATIRWSDGSTYYEDSVKGRFTISRDNAKNTVYLQMNSLKPEDTAVYYCAAAKGIGVYGYWGQGTQVTVSS

SEQ ID NO: 803 - protein, 119 aa, Artificial Sequence
  Nanobody
EVQLVESGGGLVQAGDSLRLSCAATGRTSSIYNMDWFLQAPGKERELIARIWWRSGATYYADSVKGRFTISRGNAKNTVYLQMNSLKPEDTGVYHCTAGVTGGAAYGYWGQGTQVTVSS

SEQ ID NO: 804 - protein, 118 aa, Artificial Sequence
  Nanobody
EVQLVESGGGLVQAGGSLRLSCVASGRTLRRYVTGWFRQAPGKEREVVASISWSGESTYYADSVKGRFAISRDNAKNAVYLQMNSLNLEDTGVYYCAEAELPGTYDYWGQGTQVTVSS

SEQ ID NO: 805 - protein, 117 aa, Artificial Sequence
  Nanobody
EVQLVESGGGLVQAGGSLRLTCAASGRTFSSFVIGWFRQAPGKQREVVASITSGGSTYYEDSGKGRFTISRDNAKNRVYLQMNSLRPEDTAVYYCAAAEPAGVYDVWGQGTQVTVSS

SEQ ID NO: 806 - protein, 124 aa, Artificial Sequence
  Nanobody
EVQLVESGGGLVQAGGSLRLSCAASGLTFNQYTITWFRQAPGKEREFVAAVSWSGSSESVSNSVKGRFTISRDNAKNTAYLAMNSLKPEDTAVYYCAADRRGLASTRAADYDYWGQGTQVTVSS

SEQ ID NO: 807 - protein, 119 aa, Artificial Sequence
  Nanobody
EVQLVESGGGLVQAGDSLRLSCAATGRTSSIYNMDWFRQGSGKGRELIARIWWRSGETYYADSVKGRFTISRDNAKNTVYLQMNSLKPEDTNVYHCAAGDTGGASYGYWGQGTQVTVSS

SEQ ID NO: 808 - protein, 213 aa, Homo sapiens
MQLPLALCLVCLLVHTAFRVVEGQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQTVQLLCPGGEAPRARKVRLVASCKCKRLTRFHNQSELKDFGTEAARPQKGRKPRPRARSAKANQAELENAY

SEQ ID NO: 809 - protein, 213 aa, Artificial Sequence
  Recombinant sclerostin
MPLLLLLPLLWAGALAHHHHHHHQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 810 - DNA, 798 bp, Homo sapiens
atgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctcaggtcatcagactgtgcctcaggattgtgttgtgatagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacac

SEQ ID NO: 811 - protein, 266 aa, Homo sapiens
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCDRHFWSKICKPVLKEGQVCTKHRRKGSHGLEIFQRCYCGEGLSCRIQKDHHQASNSSRLHTCQRH

SEQ ID NO: 812 - DNA, 816 bp, Mus musculus
atgatggttgtgtgtgcagcggcagctgtccggttcttggccgtgtttacaatgatggctctctgcagcctccctctgctaggagccagtgccaccttgaactcagttctcatcaattccaacgcgatcaagaacctgcccccaccgctgggtggtgctggggggcagccgggctctgctgtcagtgtggcgccgggagttctctatgagggcgggaacaagtaccagactcttgacaactaccagccctacccttgcgctgaagatgaggagtgcggctctgacgagtactgctccagccccagccgcggggcagccggcgtcggaggtgtacagatctgtctggcttgccgaaagcgcaggaagcgctgcatgaggcacgctatgtgctgccccgggaactactgcaaaaatggaatatgcatgccctctgaccacagccattttcctcgaggggagattgaggaaagcatcattgaaaaccttggtaatgaccacaacgccgccgcgggggatggatatcccagaagaaccacactgacttcaaaaatatatcacaccaaaggacaagaaggctccgtctgcctccgatcatcagactgtgccgcagggctgtgttgtgcaagacacttctggtccaagatctgtaaacctgtccttaaagaaggtcaggtgtgcaccaagcacaaacggaaaggctcccacgggctggagatattccagcgctgttactgcggggaaggcctggcttgcaggatacagaaagatcaccatcaagccagcaattcttctaggctccacacctgccagagacac

SEQ ID NO: 813 - protein, 272 aa, Mus musculus
MMVVCAAAAVRFLAVFTMMALCSLPLLGASATLNSVLINSNAIKNLPPPLGGAGGQPGSAVSVAPGVLYEGGNKYQTLDNYQPYPCAEDEECGSDEYCSSPSRGAAGVGGVQICLACRKRRKRCMRHAMCCPGNYCKNGICMPSDHSHFPRGEIEESIIENLGNDHNAAAGDGYPRRTTLTSKIYHTKGQEGSVCLRSSDCAAGLCCARHFWSKICKPVLKEGQVCTKHKRKGSHGLEIFQRCYCGEGLACRIQKDHHQASNSSRLHTCQRH

SEQ ID NO: 814 - DNA, 810 bp, Rattus rattus
atgacggttgtgcgtgcagtggcagctgtccggttcttggtcgtgcttacaacgatggctctctgcagcctccctccgctcggagtcagcgccactttgaactcagttctcatcaattccaacgcgatcaagaacctgcccccaccgctgggtggtgctggggggcagccgggctctgctgtcagcgtggcgcccggagtcctctatgagggcgggaacaagtaccagactcttgacaactaccagccctacccttgcgcggaggatgaggagtgcggcactgacgagtactgctccagtcccagccgcggggcagccggcgtgggaggtgtacaaatctgcctggcttgccgaaagcgcaggaaacgctgcatgaggcacgctatgtgctgccccgggaattactgcaaaaacggaatatgcatgccctctgaccacagccatttacctcgaggggaaatcgaggaaggcatcattgaaaaccttggcaatgaccacggtgccggggatggatatcccagaagaaccacactgacttcaaaaatatatcacaccaaagggcaagaaggctctgtctgcctccgatcatcagactgcgccacagggctgtgttgtgcaagacatttctggtccaagatctgtaaacctgtccttaaagaaggtcaggtatgcaccaagcacagaaggaaaggctcccacgggctggagatattccagcgctgttactgtggggaaggtctggcttgcaggatacagaaagatcaccatcaaaccagcaattcttccaggctccacacctgccagagacac

SEQ ID NO: 815 - protein, 270 aa, Rattus rattus
MTVVRAVAAVRFLVVLTTMALCSLPPLGVSATLNSVLINSNAIKNLPPPLGGAGGQPGSAVSVAPGVLYEGGNKYQTLDNYQPYPCAEDEECGTDEYCSSPSRGAAGVGGVQICLACRKRRKRCMRHAMCCPGNYCKNGICMPSDHSHLPRGEIEEGIIENLGNDHGAGDGYPRRTTLTSKIYHTKGQEGSVCLRSSDCATGLCCARHFWSKICKPVLKEGQVCTKHRRKGSHGLEIFQRCYCGEGLACRIQKDHHQTSNSSRLHTCQRH

SEQ ID NO: 816 - DNA, 798 bp, ARTIFICIAL SEQUENCE
  Cyno DKK-1
  CDS (1)..(798)
atgatggctctgggcgcagcaggagctgcccgggtcttggtcgcgctggtagcggcggctcttggcggccaccctctgctgggagtgagcgccaccttgaactcggttctcaattccaacgcgatcaagaacctgcccccaccgctgggcggcgctgcggggcacccaggctctgcagtcagcgccgcgccaggaattctgtacccgggcgggaataagtaccagaccattgacaactaccagccgtacccttgcgcagaggatgaggagtgcggcactgatgagtactgcgctagtcccacccgcggaggggacgcgggcgtgcaaatctgtctcgcctgcaggaagcgccgaaaacgctgcatgcgtcacgctatgtgctgccccgggaattactgcaaaaatggaatatgtgtgtcttctgatcaaaataatttccgaggggaaattgaggaaaccattactgaaagctttggtaatgatcatagcactttggatgggtattccagaagaacaacattgtcttcaaaaatgtatcacagcaaaggacaagaaggttctgtgtgtctccggtcatcagactgtgccacaggactgtgttgtgctagacacttctggtccaagatctgtaaacctgtcctcaaagaaggtcaagtgtgtaccaagcatagaagaaaaggctctcatgggctagaaatattccagcgttgttactgcggagaaggtctgtcttgccggatacagaaagatcaccatcaagccagtaattcttctaggcttcacacttgtcagagacac

SEQ ID NO: 817 - protein, 266 aa, ARTIFICIAL SEQUENCE
  Synthetic Construct
MMALGAAGAARVLVALVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNNFRGEIEETITESFGNDHSTLDGYSRRTTLSSKMYHSKGQEGSVCLRSSDCATGLCCARHFWSKICKPVLKEGQVCTKHRRKGSHGLEIFQRCYCGEGLSCRIQKDHHQASNSSRLHTCQRH

SEQ ID NO: 818 - protein, 103 aa, Homo sapiens
  MISC_FEATURE: DKK-1 mAbs 11H10Hu VH
EIVLTQSPATLSLSPGERATLSCRASQWVSSYLAWYQQKPGQAPRLLIYDASNRATGIPARFSGSGSGTDFTLTISSLEPEDFAVYYCAWQEFFGQGTKLEIK

SEQ ID NO: 819 - protein, 120 aa, Homo sapiens
  MISC_FEATURE: DKK-1 mAbs 11H10Hu VL CDR1
EVQLVQSGGGLVQPGGSLRLSCTASGFTFSNHWIHWVRQAPGKGLEWVSGINWNSGSRGYSDSVKGRFTISRDNAKNSLYLQMNSLRAEDTAVYYCARERPVATGAFDIWGQGTTVTVSS

SEQ ID NO: 820 - protein, 11 aa, Homo sapiens
  MISC_FEATURE: DKK-1 mAbs 11H10Hu VL CDR2
RASQWVSSYLA

SEQ ID NO: 821 - protein, 7 aa, Homo sapiens
  MISC_FEATURE: DKK-1 mAbs 11H10Hu VL CDR3
DASNRAT

SEQ ID NO: 822 - protein, 5 aa, Homo sapiens
  MISC_FEATURE: DKK-1 mAbs 11H10Hu VH CDR1
AWQEF

SEQ ID NO: 823 - protein, 5 aa, Homo sapiens
NHWIH

SEQ ID NO: 824 - protein, 17 aa, Homo sapiens
  MISC_FEATURE: DKK-1 mAbs 11H10Hu VH CDR2
GINWNSGSRGYSDSVKG

SEQ ID NO: 825 - protein, 11 aa, Homo sapiens
  MISC_FEATURE: DKK-1 mAbs 11H10Hu VH CDR3
ERPVATGAFDI

SEQ ID NO: 826 - protein, 107 aa, Rattus norvegicus
  MISC_FEATURE: DKK-1 mAbs 11H10Rat VL
DIRMTQSPASLSASLGETVNIECLASEDIYSDLAWYQQKPGKSPQLLIYNANSLQNGVPSRFSGSGSGTQYSLKINSLQSEDVATYFCQQYNNYPPTFGGGTKLELK

SEQ ID NO: 827 - protein, 120 aa, Rattus norvegicus
  MISC_FEATURE: DKK-1 mAbs 11H10Rat VH
EVQLVESGGGLVQPANSLKLSCAASGFTFSDYAMAWVRQSPKKGLEWVATIIYDGSSTYYRDSVKGRFTISRDNAKSTLYLQMDSLRSEDTATYYCATGLGIATDYFDYWGQGVLVTVSS

SEQ ID NO: 828 - protein, 11 aa, Rattus norvegicus
  MISC_FEATURE: DKK-1 mAbs 11H10Rat VL CDR1
LASEDIYSDLA

SEQ ID NO: 829 - protein, 7 aa, Rattus norvegicus
  MISC_FEATURE: DKK-1 mAbs 11H10Rat VL CDR2
NANSLQN

SEQ ID NO: 830 - protein, 9 aa, Rattus norvegicus
  MISC_FEATURE: DKK-1 mAbs 11H10Rat VL CDR3
QQYNNYPPT

SEQ ID NO: 831 - protein, 5 aa, Rattus norvegicus
  MISC_FEATURE: DKK-1 mAbs 11H10Rat VH CDR1
DYAMA

SEQ ID NO: 832 - protein, 17 aa, Rattus norvegicus
  MISC_FEATURE: DKK-1 mAbs 11H10Rat VH CDR2
TIIYDGSSTYYRDSVKG

SEQ ID NO: 833 - protein, 11 aa, Rattus norvegicus
  MISC_FEATURE: DKK-1 mAbs 11H10Rat VH CDR3
GLGIATDYFDY

SEQ ID NO: 834 - protein, 107 aa, Homo sapiens
  MISC_FEATURE: DKK-1 mAbs 2.4.1 VL
DIQMTQSPSSLSASVGDRVTITCRASQGIRDDLGWFQQKPGKAPKRLIYAASSLQSGVPSRFSGSGSGTEFTLTISSLQPEDFATYYCLQHNSYPCSFGQGTKLEFK

SEQ ID NO: 835 - protein, 124 aa, Homo sapiens
  MISC_FEATURE: DKK-1 mAbs 2.4.1 VH
QVQLMQSGAEVKKPGASVKVSCKASGYTFTSYGISWVRQAPGQGLEWMGWISADNGHTNYAQKLQGRVTMTTDTSTSTAYMELRSLRSDDTAVYYCARDGELLNYYYYYGMDVWGQGTTVTVSS

SEQ ID NO: 836 - protein, 11 aa, Homo sapiens
  MISC_FEATURE: DKK-1 mAbs 2.4.1 VL CDR1
RASQGIRDDLG

SEQ ID NO: 837 - protein, 7 aa, Homo sapiens
  MISC_FEATURE: DKK-1 mAbs 2.4.1 VL CDR2
AASSLQS

SEQ ID NO: 838 - protein, 9 aa, Homo sapiens
  MISC_FEATURE: DKK-1 mAbs 2.4.1 VL CDR3
LQHNSYPCS

SEQ ID NO: 839 - protein, 5 aa, Homo sapiens
  MISC_FEATURE: DKK-1 mAbs 2.4.1 VH CDR1
SYGIS

SEQ ID NO: 840 - protein, 17 aa, Homo sapiens
  MISC_FEATURE: DKK-1 mAbs 2.4.1 VH CDR2
WISADNGHTNYAQKLQG

SEQ ID NO: 841 - protein, 15 aa, Homo sapiens
  MISC_FEATURE: DKK-1 mAbs 2.4.1 VH CDR3
DGELLNYYYYYGMDV

SEQ ID NO: 842 - protein, 112 aa, Homo sapiens
  MISC_FEATURE: DKK-1 mAbs 2.20.1 VL
DIVMTQTPLSLSVIPGQPASISCKSSQSLLHSDGKTYLYWYLQRPGQPPQLLIYEVSNRFSGVPHRLSGSGSGTDFTLKISRVEAEDVGVYYCMQSIQVPWTFGQGTKVEIK

SEQ ID NO: 843 - protein, 119 aa, Homo sapiens
  MISC_FEATURE: DKK-1 mAbs 2.20.1 VH
QVQLVESGGGVVQPGRSLRLSCAASGFTFSSYGMHWVRQAPGKGLEWVAVISYDGSDKYYADSVKGRFTISRDNSKNTLYLQMNSLRAEDTAVYYCARDQWGGSPAGPWGQGTLVTVSS

SEQ ID NO: 844 - protein, 16 aa, Homo sapiens
  MISC_FEATURE: DKK-1 mAbs 2.20.1 VL CDR1
KSSQSLLHSDGKTYLY

SEQ ID NO: 845 - protein, 7 aa, Homo sapiens
  MISC_FEATURE: DKK-1 mAbs 2.20.1 VL CDR2
EVSNRFS

SEQ ID NO: 846 - protein, 9 aa, Homo sapiens
  MISC_FEATURE: DKK-1 mAbs 2.20.1 VL CDR3
MQSIQVPWT

SEQ ID NO: 847 - protein, 5 aa, Homo sapiens
  MISC_FEATURE: DKK-1 mAbs 2.20.1 VH CDR1
SYGMH

SEQ ID NO: 848 - protein, 17 aa, Homo sapiens
  MISC_FEATURE: DKK-1 mAbs 2.20.1 VH CDR2
VISYDGSDKYYADSVKG

SEQ ID NO: 849 - protein, 10 aa, Homo sapiens
  MISC_FEATURE: DKK-1 mAbs 2.20.1 VH CDR3
DQWGGSPAGP

SEQ ID NO: 850 - protein, 108 aa, Homo sapiens
  MISC_FEATURE: DKK-1 mAbs 2.37.1 VL
EIVLTQSPGTLSLSPGERATLSCRASQSVSSNYLAWYQQKPGQAPRLLIYGASSRATGIPDRFSGSGSGTDFTLTISRLEPEDFAVYYCQQYGSSPITFGQGTRLEIK

SEQ ID NO: 851 - protein, 119 aa, Homo sapiens
  MISC_FEATURE: DKK-1 mAbs 2.37.1 VH
QVQLVESGGGVVQPGRSLRLSCAASGFTFSSYGMHWVRQAPGKGLEWVAVISYDGSDKYYADSVKGRFTFSRDNSKNTLYLQMNSLRAEDTAVYYCARELGIAASFDYWGQGTLVTVSS

SEQ ID NO: 852 - protein, 12 aa, Homo sapiens
  MISC_FEATURE: DKK-1 mAbs 2.37.1 VL CDR1
RASQSVSSNYLA

SEQ ID NO: 853 - protein, 7 aa, Homo sapiens
  MISC_FEATURE: DKK-1 mAbs 2.37.1 VL CDR2
GASSRAT

SEQ ID NO: 854 - protein, 9 aa, Homo sapiens
  MISC_FEATURE: DKK-1 mAbs 2.37.1 VL CDR3
QQYGSSPIT

SEQ ID NO: 855 - protein, 5 aa, Homo sapiens
  MISC_FEATURE: DKK-1 mAbs 2.37.1 VH CDR1
SYGMH

SEQ ID NO: 856 - protein, 17 aa, Homo sapiens
  MISC_FEATURE: DKK-1 mAbs 2.37.1 VH CDR2
VISYDGSDKYYADSVKG

SEQ ID NO: 857 - protein, 10 aa, Homo sapiens
  MISC_FEATURE: DKK-1 mAbs 2.37.1 VH CDR3
ELGIAASFDY

SEQ ID NO: 858 - protein, 112 aa, Homo sapiens
  MISC_FEATURE: DKK-1 mAbs 2.40.1 VL
DIVMTQSPLSLSVTPGQPASISCKSSQSLLHSDGKTYLYWYLQKPGQPPQLLIYEVSNRFSGVPDRFSGSGSGTDFTLKISRVEAEDVGVYYCMQSIQVPWTFGQGTKVEIK

SEQ ID NO: 859 - protein, 117 aa, Homo sapiens
  MISC_FEATURE: DKK-1 mAbs 2.40.1 VH
QVQLVESGGGVVQPGRSLRLSCAASGFTFSSYGMHWVRQAPGKGLGWVAVISYDGSDKYYADSVKGRFTISRDNSKNTLYLQMNSLRAEDTAVYYCARDLVDTAMPWGQGTTVTVSS

SEQ ID NO: 860 - protein, 16 aa, Homo sapiens
  MISC_FEATURE: DKK-1 mAbs 2.40.1 VL CDR1
KSSQSLLHSDGKTYLY

SEQ ID NO: 861 - protein, 7 aa, Homo sapiens
  MISC_FEATURE: DKK-1 mAbs 2.40.1 VL CDR2
EVSNRFS

SEQ ID NO: 862 - protein, 9 aa, Homo sapiens
  MISC_FEATURE: DKK-1 mAbs 2.40.1 VL CDR3
MQSIQVPWT

SEQ ID NO: 863 - protein, 5 aa, Homo sapiens
  MISC_FEATURE: DKK-1 mAbs 2.40.1 VH CDR1
SYGMH

SEQ ID NO: 864 - protein, 17 aa, Homo sapiens
  MISC_FEATURE: DKK-1 mAbs 2.40.1 VH CDR2
VISYDGSDKYYADSVKG

SEQ ID NO: 865 - protein, 8 aa, Homo sapiens
  MISC_FEATURE: DKK-1 mAbs 2.40.1 VH CDR3
DLVDTAMP

SEQ ID NO: 866 - protein, 112 aa, Homo sapiens
  MISC_FEATURE: DKK-1 mAbs 2.41.1 VL
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSKQLPFTFGPGTKVDIK

SEQ ID NO: 867 - protein, 122 aa, Homo sapiens
  MISC_FEATURE: DKK-1 mAbs 2.41.1 VH
QVQLVESGGGVVQPGRSLRLSCAASGFTFSSYGMHWVRQAPGKGLEWVAVISYDGSDKYYADSVKGRFTISRDNSKNTLYLQMNSLRAEDTAVYYCARAGYSLYYYYGMDVWGQGTTVTVSS

SEQ ID NO: 868 - protein, 16 aa, Homo sapiens
  MISC_FEATURE: DKK-1 mAbs 2.41.1 VL CDR1
KSSQSLLHSDGKTYLY

SEQ ID NO: 869 - protein, 7 aa, Homo sapiens
  MISC_FEATURE: DKK-1 mAbs 2.41.1 VL CDR2
EVSNRFS

SEQ ID NO: 870 - protein, 9 aa, Homo sapiens
  MISC_FEATURE: DKK-1 mAbs 2.41.1 VL CDR3
MQSKQLPFT

SEQ ID NO: 871 - protein, 5 aa, Homo sapiens
  MISC_FEATURE: DKK-1 mAbs 2.41.1 VH CDR1
SYGMH

SEQ ID NO: 872 - protein, 17 aa, Homo sapiens
  MISC_FEATURE: DKK-1 mAbs 2.41.1 VH CDR2
VISYDGSDKYYADSVKG

SEQ ID NO: 873 - protein, 13 aa, Homo sapiens
  MISC_FEATURE: DKK-1 mAbs 2.41.1 VH CDR3
AGYSLYYYYGMDV

SEQ ID NO: 874 - protein, 113 aa, Homo sapiens
  MISC_FEATURE: DKK-1 mAbs 2.47.1 VL
DIVMTQTPLSLPVTPGEPASISCRSSQSLLDSDDGDTYLDWYLQKPGQSPQLLIYTLSYRASGVPDRFSGSGSGTDFTLKISRVEAEDVGVYYCMQRIEFPFTFGPGTKVDIK

SEQ ID NO: 875 - protein, 127 aa, Homo sapiens
  MISC_FEATURE: DKK-1 mAbs 2.47.1 VH
QVQLQESGPGLVKPSQTLSLTCTVSGGSISSGGYYWSWIRQHPGKGLEWIGDIYYSGSTYYNPSLKSRVTISVDTSKNQFSLKLSSVTAADTAVYYCARDRAYGDYGGDYYYGMDVWGQGTTVTVSS

SEQ ID NO: 876 - protein, 17 aa, Homo sapiens
  MISC_FEATURE: DKK-1 mAbs 2.47.1 VL CDR1
RSSQSLLDSDDGDTYLD

SEQ ID NO: 877 - protein, 7 aa, Homo sapiens
  MISC_FEATURE: DKK-1 mAbs 2.47.1 VL CDR2
TLSYRAS

SEQ ID NO: 878 - protein, 14 aa, Homo sapiens
  MISC_FEATURE: DKK-1 mAbs 2.47.1 VL CDR3
MQRIEFPMQRIEFP

SEQ ID NO: 879 - protein, 7 aa, Homo sapiens
  MISC_FEATURE: DKK-1 mAbs 2.47.1 VH CDR1
SGGYYWS

SEQ ID NO: 880 - protein, 16 aa, Homo sapiens
  MISC_FEATURE: DKK-1 mAbs 2.47.1 VH CDR2
DIYYSGSTYYNPSLKS

SEQ ID NO: 881 - protein, 17 aa, Homo sapiens
  MISC_FEATURE: DKK-1 mAbs 2.47.1 VH CDR3
DRAYGDYGGDYYYGMDV

SEQ ID NO: 882 - protein, 107 aa, Homo sapiens
  MISC_FEATURE: DKK-1 mAbs 5.17.1 VL
DIQMTQSPSSLSASVGDRVTITCQASQDINNYLNWYQQKPGKAPNLLIYDASNLETGVPSRFSGSGSGTDFTFTISSLQPADIATYYCQQYDDFPLTFGGGTKVEIK

SEQ ID NO: 883 - protein, 118 aa, Homo sapiens
  MISC_FEATURE: DKK-1 mAbs 5.17.1 VH
QVQLQESGPGLVKPSETLSLTCTVSGGSISSYYWSWIRQPPGKGLEWIGYIYYSGNTNYNPSLKSRVTISVDTSKNQFSLKLRSVTAADTAVYYCARYNWNNDLFDYWGQGTLVTVSS

SEQ ID NO: 884 - protein, 11 aa, Homo sapiens
  MISC_FEATURE: DKK-1 mAbs 5.17.1 VL CDR1
QASQDINNYLN

SEQ ID NO: 885 - protein, 7 aa, Homo sapiens
  MISC_FEATURE: DKK-1 mAbs 5.17.1 VL CDR2
DASNLET

SEQ ID NO: 886 - protein, 9 aa, Homo sapiens
  MISC_FEATURE: DKK-1 mAbs 5.17.1 VL CDR3
QQYDDFPLT

SEQ ID NO: 887 - protein, 5 aa, Homo sapiens
  MISC_FEATURE: DKK-1 mAbs 5.17.1 VH CDR1
SYYWS

SEQ ID NO: 888 - protein, 16 aa, Homo sapiens
  MISC_FEATURE: DKK-1 mAbs 5.17.1 VH CDR2
YIYYSGNTNYNPSLKS

SEQ ID NO: 889 - protein, 10 aa, Homo sapiens
  MISC_FEATURE: DKK-1 mAbs 5.17.1 VH CDR3
YNWNNDLFDY

SEQ ID NO: 890 - protein, 107 aa, Homo sapiens
  MISC_FEATURE: DKK-1 mAbs 5.23.1 VL
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIK

SEQ ID NO: 891 - protein, 126 aa, Homo sapiens
  MISC_FEATURE: DKK-1 mAbs 5.23.1 VH
QVQLVESGGGVVQPGRSLRLSCAASGFTFSSYGMHWVRQAPGKGLEWVAVIWCDGSNKYYADSVKGRFTISRDSSKNTLYLQMNSLRAEDTAVYYCARGGYGSGSYEDYYYGMDVWGQGTTVTVSS

SEQ ID NO: 892 - protein, 11 aa, Homo sapiens
  MISC_FEATURE: DKK-1 mAbs 5.23.1 VL CDR1
QASQDISNYLN

SEQ ID NO: 893 - protein, 7 aa, Homo sapiens
  MISC_FEATURE: DKK-1 mAbs 5.23.1 VL CDR2
DASNLET

SEQ ID NO: 894 - protein, 9 aa, Homo sapiens
  MISC_FEATURE: DKK-1 mAbs 5.23.1 VL CDR3
QQYDNLPLT

SEQ ID NO: 895 - protein, 5 aa, Homo sapiens
  MISC_FEATURE: DKK-1 mAbs 5.23.1 VH CDR1
SYGMH

SEQ ID NO: 896 - protein, 17 aa, Homo sapiens
  MISC_FEATURE: DKK-1 mAbs 5.23.1 VH CDR2
VIWCDGSNKYYADSVKG

SEQ ID NO: 897 - protein, 17 aa, Homo sapiens
  MISC_FEATURE: DKK-1 mAbs 5.23.1 VH CDR3
GGYGSGSYEDYYYGMDV

SEQ ID NO: 898 - protein, 107 aa, Homo sapiens
  MISC_FEATURE: DKK-1 mAbs 5.25.1 VL
DIQMTQSPSSLSASVGDRVTITCQASQDISKDLNWYQQKPGKAPRLLIYDASNLETGVPSRFSGSGSGTDFTFTISSLQPEDIATFYCQQYDHLPIAFGQGTRLEIK

SEQ ID NO: 899 - protein, 119 aa, Homo sapiens
  MISC_FEATURE: DKK-1 mAbs 5.25.1 VH
QVQLVQSGAEVKKPGASVKVSCKASGYTFTSYDINWVRQATGQGLEWMGWMDPNSGNTGYAQKFQGRVTMTRNTSISTAFMELSSLRSEDTAVYYCARTDYFYFGMDVWGQGTTVTVSS

SEQ ID NO: 900 - protein, 11 aa, Homo sapiens
  MISC_FEATURE: DKK-1 mAps 5.25.1 VL CDR1
QASQDISKDLN

SEQ ID NO: 901 - protein, 7 aa, Homo sapiens
  MISC_FEATURE: DKK-1 mAbs 5.25.1 VL CDR2
DASNLET

SEQ ID NO: 902 - protein, 9 aa, Homo sapiens
  MISC_FEATURE: DKK-1 mAbs 5.25.1 VL CDR3
QQYDNLPLT

SEQ ID NO: 903 - protein, 5 aa, Homo sapiens
  MISC_FEATURE: DKK-1 mAbs 5.25.1 VH CDR1
SYGMH

SEQ ID NO: 904 - protein, 17 aa, Homo sapiens
  MISC_FEATURE: DKK-1 mAbs 5.25.1 VH CDR2
WMDPNSGNTGYAQKFQG

SEQ ID NO: 905 - protein, 10 aa, Homo sapiens
  MISC_FEATURE: DKK-1 mAbs VH CDR3
TDYFYFGMDV

SEQ ID NO: 906 - protein, 107 aa, Homo sapiens
  MISC_FEATURE: DKK-1 mAbs 5.31.1 VL
DIQVTQSPSSLSASVGDRVTITCQASQDISNYLNWYQQKPGKAPKFLIYDASNLEAGVPSRFSGSGSGTDFTFTISSLQPEDIATYYCQQYDNLPLTFGGGTKVEIK

SEQ ID NO: 907 - protein, 125 aa, Homo sapiens
  MISC_FEATURE: DKK-1 mAbs 5.31.1 VH
QVQLVESGGGVVQPGRSLRLSCAASGFTFSSYGMHWVRQAPGKGLEWVAVIWYDGRNKYYADSVKGRFTISRDNSKNTLYLQMNSLRAEDTAVYYCARGGGAVADYNYYYGMDVWGQGTTVTVSS

SEQ ID NO: 908 - protein, 11 aa, Homo sapiens
  MISC_FEATURE: DKK-1 mAbs 5.31.1 VL CDR1
QASQDISNYLN

SEQ ID NO: 909 - protein, 7 aa, Homo sapiens
  MISC_FEATURE: DKK-1 mAbs 5.31.1 VL CDR2
DASNLEA

SEQ ID NO: 910 - protein, 9 aa, Homo sapiens
  MISC_FEATURE: DKK-1 mAbs 5.31.1 VL CDR3
QQYDNLPLT

SEQ ID NO: 911 - protein, 5 aa, Homo sapiens
  MISC_FEATURE: DKK-1 mAbs 5.31.1 VH CDR1
SYGMH

SEQ ID NO: 912 - protein, 17 aa, Homo sapiens
  MISC_FEATURE: DKK-1 mAbs 5.31.1 VH CDR2
VIWYDGRNKYYADSVKG

SEQ ID NO: 913 - protein, 16 aa, Homo sapiens
  MISC_FEATURE: DKK-1 mAbs 5.31.1 VH CDR3
GGGAVADYNYYYGMDV

SEQ ID NO: 914 - protein, 107 aa, Homo sapiens
  MISC_FEATURE: DKK-1 mAbs 5.32.1 VL
DIQMTQSPSSLSASVGDRVTITCQASQDISKDLNWYQQKPGKAPKLLIYDASNLETGVPSRFSGSGSGTDFTFTISSLQPEDIATYYCQQYDDLPITFGQGTRLEIK

SEQ ID NO: 915 - protein, 119 aa, Homo sapiens
  MISC_FEATURE: DKK-1 mAbs 5.32.1 VH
QVQLVQSGAEVKKPGASVKVSCKASGFTFTSYDISWVRQATGLGLEWMGWMNPSSGYTGYAQNFQGRVTMTWNTSISTVYMELSSLRSEDTAVYYCARTDYYYYGMDVWGRGTTVTVSS

SEQ ID NO: 916 - protein, 11 aa, Homo sapiens
  MISC_FEATURE: DKK-1 mAbs 5.32.1 VL CDR1
QASQDISKDLN

SEQ ID NO: 917 - protein, 7 aa, Homo sapiens
  MISC_FEATURE: DKK-1 mAbs 5.32.1 VL CDR2
DASNLET

SEQ ID NO: 918 - protein, 9 aa, Homo sapiens
  MISC_FEATURE: DKK-1 mAbs 5.32.1 VL CDR3
QQYDDLPIT

SEQ ID NO: 919 - protein, 5 aa, Homo sapiens
  MISC_FEATURE: DKK-1 mAbs 5.32.1 VH CDR1
SYDIS

SEQ ID NO: 920 - protein, 17 aa, Homo sapiens
  MISC_FEATURE: DKK-1 mAbs 5.32.1 VH CDR2
WMNPSSGYTGYAQNFQG

SEQ ID NO: 921 - protein, 10 aa, Homo sapiens
  MISC_FEATURE: DKK-1 mAbs 5.32.1 VH CDR3
TDYYYYGMDV

SEQ ID NO: 922 - protein, 107 aa, Homo sapiens
  MISC_FEATURE: DKK-1 mAbs 5.40.1 VL
DIRLTQSPSSLSASVGDRVTITCQASQDISNYLNWYQQEPGKAPKLLIYDASNLETGVPSRFSGSGSGTDFTFTISSLQPEDIATYYCQQYDNFPLTFGGGTKVEIK

SEQ ID NO: 923 - protein, 118 aa, Homo sapiens
  MISC_FEATURE: DKK-1 mAbs 5.40.1 VH
QVLLQESGPGLVKPSETLSLTCTVSGGSISSYYWSWIRQTPGKGLEWIGYVYYSGSTSYNPSLKSRVTISMYTSKTEFSLKLSSVTAADTAVYYCARYNWNNDLFDYWGQGTLVTVSS

SEQ ID NO: 924 - protein, 11 aa, Homo sapiens
  MISC_FEATURE: DKK-1 mAbs 5.40.1 VL CDR1
QASQDISNYLN

SEQ ID NO: 925 - protein, 7 aa, Homo sapiens
  MISC_FEATURE: DKK-1 mAbs 5.40.1 VL CDR2
DASNLET

SEQ ID NO: 926 - protein, 9 aa, Homo sapiens
  MISC_FEATURE: DKK-1 mAbs 5.40.1 VL CDR3
QQYDNFPLT

SEQ ID NO: 927 - protein, 5 aa, Homo sapiens
  MISC_FEATURE: DKK-1 mAbs 5.40.1 VH CDR1
SYYWS

SEQ ID NO: 928 - protein, 16 aa, Homo sapiens
  MISC_FEATURE: DKK-1 mAbs 5.40.1 VH CDR2
YVYYSGSTSYNPSLKS

SEQ ID NO: 929 - protein, 10 aa, Homo sapiens
  MISC_FEATURE: DKK-1 mAbs 5.40.1 VH CDR3
YNWNNDLFDY

SEQ ID NO: 930 - protein, 108 aa, Homo sapiens
  MISC_FEATURE: DKK-1 mAbs 5.65.1 VL
SYVLTQPPSVSVAPGQTARITCGGNNIGSKSVHWYQQKPGQAPVLVVYDDSDRPSGIPERFSGSNSGNTATLTISRVEAGDEADYYCQVLDSSSDHVIFGGGTKLTVL

SEQ ID NO: 931 - protein, 120 aa, Homo sapiens
  MISC_FEATURE: DKK-1 mAbs 5.65.1 VH
EVQLLESGGGLVQPGGSLRLSCAASGFTSGNYAMSWVRQAPGKGLEWVSAISGGGGTTYYADSVEGRFTISRDNSKNTLYLQLNSLRAEDTAVYYCAKEFGELEPRFDYWGQGTLVTVSS

SEQ ID NO: 932 - protein, 11 aa, Homo sapiens
  MISC_FEATURE: DKK-1 mAbs 5.65.1 VL CDR1
GGNNIGSKSVH

SEQ ID NO: 933 - protein, 7 aa, Homo sapiens
  MISC_FEATURE: DKK-1 mAbs 5.65.1 VL CDR2
DDSDRPS

SEQ ID NO: 934 - protein, 11 aa, Homo sapiens
  MISC_FEATURE: DKK-1 mAbs 5.65.1 VL CDR3
QVLDSSSDHVI

SEQ ID NO: 935 - protein, 5 aa, Homo sapiens
  MISC_FEATURE: DKK-1 mAbs 5.65.1 VH CDR1
NYAMS

SEQ ID NO: 936 - protein, 17 aa, Homo sapiens
  MISC_FEATURE: DKK-1 mAbs 5.65.1 VH CDR2
AISGGGGTTYYADSVEG

SEQ ID NO: 937 - protein, 11 aa, Homo sapiens
  MISC_FEATURE: DKK-1 mAbs 5.65.1 VH CDR3
EFGELEPRFDY

SEQ ID NO: 938 - protein, 108 aa, Homo sapiens
  MISC_FEATURE: DKK-1 mAbs 5.76.1 VL
SYVLTQPPSVSVAPGQTARITCGGNNIGSESVHWYQQKPGQAPVLVVYDDSDRPSGIPERFSGSNSGNTATLTISRVEAGDEADYYCQVWDSSNDHVVFGGGTKLTVL

SEQ ID NO: 939 - protein, 124 aa, Homo sapiens
  MISC_FEATURE: DKK-1 mABs 5.76.1 VH
QLQLQESGPGLVKPSETLSLTCTVSGGSISSSNYYWGWIRQPPGKGLEWIGTIYYSGSTYYTPSLKSRVTISVDTSKNQFSLKLSSVTAADTAVYYCARERAIAVAAIVFFDYWGQGTLVTVSS

SEQ ID NO: 940 - protein, 11 aa, Homo sapiens
  MISC_FEATURE: DKK-1 mAbs 5.76.1 VL CDR1
GGNNIGSESVH

SEQ ID NO: 941 - protein, 7 aa, Homo sapiens
  MISC_FEATURE: DKK-1 mAbs 5.76.1 VL CDR2
DDSDRPS

SEQ ID NO: 942 - protein, 11 aa, Homo sapiens
  MISC_FEATURE: DKK-1 mAbs 5.76.1 VL CDR3
QVWDSSNDHVV

SEQ ID NO: 943 - protein, 7 aa, Homo sapiens
  MISC_FEATURE: DKK-1 mAbs 5.76.1 VH CDR1
SSNYYWG

SEQ ID NO: 944 - protein, 16 aa, Homo sapiens
  MISC_FEATURE: DKK-1 mAbs 5.76.1 VH CDR2
TIYYSGSTYYTPSLKS

SEQ ID NO: 945 - protein, 14 aa, Homo sapiens
  MISC_FEATURE: DKK-1 mAbs 5.76.1 VH CDR3
ERAIAVAAIVFFDY

SEQ ID NO: 946 - protein, 103 aa, Homo sapiens
  MISC_FEATURE: DKK-1 mAbs 5.77.1 VL
QSPSVSVAPGQTARITCGGNNIGSKSVHWYQQKPGQAPVLVVYDDSDRPSGIPERFSGSNSGNTATLTISRVEAGDEADYYCQVWDSSSDHWVFGGGTKLTVL

SEQ ID NO: 947 - protein, 123 aa, Homo sapiens
  MISC_FEATURE: DKK-1 mAbs 5.77.1 VH
QVQLVQSGAEVKKPGASVKVSCKASGYTFTSYDINWVRQATGQGLEWMGWMNLNSDNTGYAQKFQGRVTMTRNTSISTAYMELSSLRSEDTAVYYCASIAARRDYNYYGMDVWGQGTKVTVSS

SEQ ID NO: 948 - protein, 11 aa, Homo sapiens
  MISC_FEATURE: DKK-1 mAbs 5.77.1 VL CDR1
GGNNIGSKSVH

SEQ ID NO: 949 - protein, 7 aa, Homo sapiens
  MISC_FEATURE: DKK-1 mAbs 5.77.1 VL CDR2
DDSDRPS

SEQ ID NO: 950 - protein, 11 aa, Homo sapiens
  MISC_FEATURE: DKK-1 mAbs  5.77.1 VL CDR3
QVWDSSSDHWV

SEQ ID NO: 951 - protein, 5 aa, Homo sapiens
  MISC_FEATURE: DKK-1 mAbs 5.77.1 VH CDR1
SYDIN

SEQ ID NO: 952 - protein, 17 aa, Homo sapiens
  MISC_FEATURE: DKK-1 mAbs 5.77.1 VH CDR2
WMNLNSDNTGYAQKFQG

SEQ ID NO: 953 - protein, 14 aa, Homo sapiens
  MISC_FEATURE: DKK-1 mAbs 5.77.1 VH CDR3
IAARRDYNYYGMDV

SEQ ID NO: 954 - protein, 107 aa, Homo sapiens
  MISC_FEATURE: DKK-1 mAbs 5.78.1 VL
EIVLTQSPGTLSVSPGERATLSCRASQSVSSSYLAWYQQKPGQAPRLLIYGASGRATGIPDRFSGSGSGTDFILTISRLEPEDFAVYYCQQYGSSFTFGGGTKVEIK

SEQ ID NO: 955 - protein, 125 aa, Homo sapiens
  MISC_FEATURE: DKK-1 mAbs 5.78.1 VH
QVQLVESGGGVVQPGRSLRLSCAASGFTFSSYGMHWVRQAPGKGLEWVAVILYDGSDNYYADSVKGRFTISRDNSKNTLYLQMNSLRAEDTAVYYCAREGIAVAGDYYYYGMDVWGQGTTVTVSS

SEQ ID NO: 956 - protein, 12 aa, Homo sapiens
  MISC_FEATURE: DKK-1 mAbs 5.78.1 VL CDR1
RASQSVSSSYLA

SEQ ID NO: 957 - protein, 7 aa, Homo sapiens
  MISC_FEATURE: DKK-1 mAbs 5.78.1 VL CDR2
GASGRAT

SEQ ID NO: 958 - protein, 8 aa, Homo sapiens
  MISC_FEATURE: DKK-1 mAbs 5.78.1 VL CDR3
QQYGSSFT

SEQ ID NO: 959 - protein, 5 aa, Homo sapiens
  MISC_FEATURE: DKK-1 mAbs 5.78.1 VH CDR1
SYGMH

SEQ ID NO: 960 - protein, 17 aa, Homo sapiens
  MISC_FEATURE: DKK-1 mAbs 5.78.1 VH CDR2
VILYDGSDNYYADSVKG

SEQ ID NO: 961 - protein, 16 aa, Homo sapiens
  MISC_FEATURE: DKK-1 mAbs 5.78.1 VH CDR3
EGIAVAGDYYYYGMDV

SEQ ID NO: 962 - protein, 112 aa, Homo sapiens
  MISC_FEATURE: DKK-1 mAbs 5.80.1 VL
QSVLTQPPSVSGAPGQRVTISCTGSSSNIGADYDVHWYQQLPGTAPKLLIYDYSNRPSGVPDRFSGSKSGTSASLAITGLQAEDEADYYCQSYDNSLSGYVVFGGGTKLTVL

SEQ ID NO: 963 - protein, 116 aa, Homo sapiens
  MISC_FEATURE: DKK-1 mAbs 5.80.1 VH
EVQLVQSGAEVKKPGESLKISCKGSGYSFTSYWIGWVRQMPGKGLEWMGIIYPGDSDTRYSPSFQGQVTISADKSISTAYLQWSSLTASDTAMYYCARQGESFDYWGQGTLVTVSS

SEQ ID NO: 964 - protein, 14 aa, Homo sapiens
  MISC_FEATURE: DKK-1 mAbs 5.80.1 VL CDR1
TGSSSNIGADYDVH

SEQ ID NO: 965 - protein, 7 aa, Homo sapiens
  MISC_FEATURE: DKK-1 mAbs 5.80.1 VL CDR2
DYSNRPS

SEQ ID NO: 966 - protein, 12 aa, Homo sapiens
  MISC_FEATURE: DKK-1 mAbs 5.80.1 VL CDR3
QSYDNSLSGYVV

SEQ ID NO: 967 - protein, 5 aa, Homo sapiens
  MISC_FEATURE: DKK-1 mAbs 5.80.1 VH CDR1
SYWIG

SEQ ID NO: 968 - protein, 17 aa, Homo sapiens
  MISC_FEATURE: DKK-1 mAbs 5.80.1 VH CDR2
IIYPGDSDTRYSPSFQG

SEQ ID NO: 969 - protein, 7 aa, Homo sapiens
  MISC_FEATURE: DKK-1 mAbs 5.80.1 VH CDR3
QGESFDY

SEQ ID NO: 970 - protein, 110 aa, Homo sapiens
  MISC_FEATURE: DKK-1 mAbs 5.85.1 VL
QSVLTQPPSVSGAPGQRVTISCTGSSSNIGAGYDVHWYQQLPRTAPKLLIYGNSNRPSGVPDRFSDSKSGTSASLAITGLQAEDEADYYCQSYDSSLSVIFGGGTKLTVL

SEQ ID NO: 971 - protein, 116 aa, Homo sapiens
  MISC_FEATURE: DKK-1 mAbs 5.85.1 VH
EVQLVQSGAEVKKPGESLKISCKVSGYSFTTYWIGWVRQMPGKGLDWMGIIYPGDSDTRYSPSFQGQVTISADKSISTAYLQWSSLKASDTAMYYCARQGIAFDYWGQGTLVTVSS

SEQ ID NO: 972 - protein, 14 aa, Homo sapiens
  MISC_FEATURE: DKK-1 mAbs 5.85.1 VL CDR1
TGSSSNIGAGYDVH

SEQ ID NO: 973 - protein, 7 aa, Homo sapiens
  MISC_FEATURE: DKK-1 mAbs 5.85.1 VL CDR2
GNSNRPS

SEQ ID NO: 974 - protein, 10 aa, Homo sapiens
  MISC_FEATURE: DKK-1 mAbs 5.85.1 VL CDR3
QSYDSSLSVI

SEQ ID NO: 975 - protein, 5 aa, Homo sapiens
  MISC_FEATURE: DKK-1 mAbs 5.85.1 VH CDR1
TYWIG

SEQ ID NO: 976 - protein, 17 aa, Homo sapiens
  MISC_FEATURE: DKK-1 mAbs 5.85.1 VH CDR2
IIYPGDSDTRYSPSFQG

SEQ ID NO: 977 - protein, 7 aa, Homo sapiens
  MISC_FEATURE: DKK-1 mAbs 5.85.1 VH CDR3
QGIAFDY

SEQ ID NO: 978 - protein, 112 aa, Homo sapiens
  MISC_FEATURE: DKK-1 mAbs 6.37.5 VL
DIVMTQTPLSLSVTPGQPASISCKSGQSLLHSDGKTYLYWYLQKPGQPPQFLIYEVSNRFSRVPDRFSGSGSGTDFTLRISRVEAEDVGIYYCMQSIQLPWTFGQGTQVEIK

SEQ ID NO: 979 - protein, 114 aa, Homo sapiens
  MISC_FEATURE: DKK-1 mAbs 6.37.5 VH
QVQLVESGGGVVQPGRSLRLSCAASGFTFSGYGMHWVRQAPGKGLEWVAVISYDGNDKYYADSVKGRFTISRDNAKNTLYLQMNSLRAEDTAVYYCARELRVLWGQGTLVTVSS

SEQ ID NO: 980 - protein, 16 aa, Homo sapiens
  MISC_FEATURE: DKK-1 mAbs 6.37.5 VL CDR1
KSGQSLLHSDGKTYLY

SEQ ID NO: 981 - protein, 7 aa, Homo sapiens
  MISC_FEATURE: DKK-1 mAbs 6.37.5 VL CDR2
EVSNRFS

SEQ ID NO: 982 - protein, 9 aa, Homo sapiens
  MISC_FEATURE: DKK-1 mAbs 6.37.5 VL CDR3
MQSIQLPWT

SEQ ID NO: 983 - protein, 5 aa, Homo sapiens
  MISC_FEATURE: DKK-1 mAbs 6.37.5 VH CDR1
GYGMH

SEQ ID NO: 984 - protein, 17 aa, Homo sapiens
  MISC_FEATURE: DKK-1 mAbs 6.37.5 VH CDR2
VISYDGNDKYYADSVKG

SEQ ID NO: 985 - protein, 5 aa, Homo sapiens
  MISC_FEATURE: DDK-1 mAbs 6.37.5 VH CDR3
ELRVL

SEQ ID NO: 986 - protein, 112 aa, Homo sapiens
  MISC_FEATURE: DDK-1 mAbs 6.116.6 VL
DIVMTQTPLSLSVTPGQPASISCKSGQSLLHNDGKTYLYWYLQKPGQPPQFLIYEVSNRFSRVPDRFSGSGSGTDFTLKISRVEAEDVGIYYCMQSIQLPWTFGQGTQVEIK

SEQ ID NO: 987 - protein, 114 aa, Homo sapiens; identical to SEQ ID NO: 979
  MISC_FEATURE: DDK-1 mAbs 6.116.6 VH

SEQ ID NO: 988 - protein, 16 aa, Homo sapiens
  MISC_FEATURE: DKK-1 mAbs 6.116.6 VL CDR1
KSGQSLLHNDGKTYLY

SEQ ID NO: 989 - protein, 7 aa, Homo sapiens
  MISC_FEATURE: DKK-1 mAbs 6.116.6 VL CDR2
EVSNRFS

SEQ ID NO: 990 - protein, 9 aa, Homo sapiens
  MISC_FEATURE: DKK-1 mAbs 6.116.6 VL CDR3
MQSIQLPWT

SEQ ID NO: 991 - protein, 5 aa, Homo sapiens
  MISC_FEATURE: DKK-1 mAbs 6.116.6 VH CDR1
GYGMH

SEQ ID NO: 992 - protein, 17 aa, Homo sapiens
  MISC_FEATURE: DKK-1 mAbs 6.116.6 VH CDR2
VISYDGNDKYYADSVKG

SEQ ID NO: 993 - protein, 5 aa, Homo sapiens
  MISC_FEATURE: DKK-1 mAbs 6.116.6 VH CDR3
ELRVL

SEQ ID NO: 994 - protein, 112 aa, Homo sapiens
  MISC_FEATURE: DKK-1 mAbs 6.139.5 VL
DIVMTQTPLSLSVTPRQPASISCKSSQSLLHSDGKTYLYWYLQKPGQPPQFLIYEVSNRFSGVPDRFSGSGSGTDFTLKISRVEAEDVGVYYCMQSIQLPWTFGQGTKVEIK

SEQ ID NO: 995 - protein, 114 aa, Homo sapiens
  MISC_FEATURE: DKK-1 mAbs 6.139.5 VH
QVQLVESGGGVVQPGRSLRLSCAASGFTFSSYGMHWVRQAPGKGLEWVAVISYDGGDQYYADSVKGRFTISRDNSKNTLYLQMNSLRTEDTAEYYCARELRVLWGQGTLVTVSS

SEQ ID NO: 996 - protein, 13 aa, Homo sapiens
  MISC_FEATURE: DKK-1 mAbs 6.139.5 VL CDR1
AASGFTFSRYDMH

SEQ ID NO: 997 - protein, 12 aa, Homo sapiens
  MISC_FEATURE: DKK-1 mAbs 6.139.5 VL CDR2
IFYDGSNKYYAD

SEQ ID NO: 998 - protein, 9 aa, Homo sapiens
  MISC_FEATURE: DKK-1 mAbs 6.139.5 VL CDR3
ATLAAAFDY

SEQ ID NO: 999 - protein, 5 aa, Homo sapiens
  MISC_FEATURE: DKK-1 mAbs 6.139.5 VH CDR1
SYGMH

SEQ ID NO: 1000 - protein, 17 aa, Homo sapiens
  MISC_FEATURE: DKK-1 mAbs 6.139.5 VH CDR2
VISYDGGDQYYADSVKG

SEQ ID NO: 1001 - protein, 5 aa, Homo sapiens
  MISC_FEATURE: DKK-1 mAbs 6.139.5 VH CDR3
ELRVL

SEQ ID NO: 1002 - protein, 107 aa, Homo sapiens
  MISC_FEATURE: DKK-1 mAbs 6.147.4 VL
YVLTQPPSVSVAPGQTARITCGGNNIGSKSVHWYQQKPGQAPVLVVYDDSDRPSEIPERFSGSNSGNTATLTISRVEAGDEADYYCQVWDSSSDHVVFGGGTRLTVL

SEQ ID NO: 1003 - protein, 116 aa, Homo sapiens
  MISC_FEATURE: DKK-1 mAbs 6.147.4 VH
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSS

SEQ ID NO: 1004 - protein, 11 aa, Homo sapiens
  MISC_FEATURE: DKK-1 mAbs 6.147.4 VL CDR1
GGNNIGSKSVH

SEQ ID NO: 1005 - protein, 7 aa, Homo sapiens
  MISC_FEATURE: DKK-1 mAbs 6.147.4 VL CDR2
DDSDRPS

SEQ ID NO: 1006 - protein, 11 aa, Homo sapiens
  MISC_FEATURE: DKK-1 mAbs 6.147.4 VL CDR3
QVWDSSSDHVV

SEQ ID NO: 1007 - protein, 5 aa, Homo sapiens
  MISC_FEATURE: DKK-1 mAbs 6.147.4 VH CDR1
RYDMH

SEQ ID NO: 1008 - protein, 17 aa, Homo sapiens
  MISC_FEATURE: DKK-1 mAbs 6.147.4 VH CDR2
IIFYDGSNKYYADPVKG

SEQ ID NO: 1009 - protein, 7 aa, Homo sapiens
  MISC_FEATURE: DKK-1 mAbs 6.147.4 VH CDR3
LAAAFDY

SEQ ID NO: 1010 - protein, 110 aa, Homo sapiens
SYVLTQPPSVSVAPGQTARITCGGDNIGSISVHWYQQKPGQAPVLVVYDDSDRPSGIPERFSGSNSGNTATLTISWVEAGDEADYYCQVWDSSIDHPVLFGGGTKLTVLG

SEQ ID NO: 1011 - protein, 123 aa, Homo sapiens
EVQLVESGGGLVQPGGSLRLSCAASGFTFSSYDMHWVRQATGKGLEWVSAIGTAGDTYYAGSVKGRFTISRENAKNSLYLQMNSLRVGDTAVYYCARSWGEGNYYFYYGMDVWGQGTTVTVSS

SEQ ID NO: 1012 - protein, 11 aa, Homo sapiens
  MISC_FEATURE: 19D11 VL CDR1
GGDNIGSISVH

SEQ ID NO: 1013 - protein, 7 aa, Homo sapiens
  MISC_FEATURE: 19D11 VL CDR2
DDSDRPS

SEQ ID NO: 1014 - protein, 12 aa, Homo sapiens
  MISC_FEATURE: 19D11 VL CDR3
QVWDSSIDHPVL

SEQ ID NO: 1015 - protein, 5 aa, Homo sapiens
  MISC_FEATURE: 19D11 VH CDR1
SYDMH

SEQ ID NO: 1016 - protein, 16 aa, Homo sapiens
  MISC_FEATURE: 19D11 VH CDR2
AIGTAGDTYYAGSVKG

SEQ ID NO: 1017 - protein, 15 aa, Homo sapiens
  MISC_FEATURE: 19D11 VH CDR3
SWGEGNYYFYYGMDV

SEQ ID NO: 1018 - protein, 111 aa, Homo sapiens
QSALTQPASVSGSPGQSITISCTGTSSDVGGYNYVSWYQQHPGKAPKLMIYEVSYRPSGVSNRFSGSKSGSTASLTISGLQPEDEADYYCSSYAISSTLVFGGGTKMTVLG

SEQ ID NO: 1019 - protein, 118 aa, Homo sapiens
QVQLQESGPGLVKPSETLSLTCTVSGGSISSYYWSWIRQPPGKGLEWIGYISDSGSTNYNPSLKSRIPISVDTSKNQFSLKLSSVTAADTAVYYCARWQLAHDAFDIWGQGTMVTVSS

SEQ ID NO: 1020 - protein, 14 aa, Homo sapiens
  MISC_FEATURE: 20C3 VL CDR1
TGTSSDVGGYNYVS

SEQ ID NO: 1021 - protein, 7 aa, Homo sapiens
  MISC_FEATURE: 20C3 VL CDR2
EVSYRPS

SEQ ID NO: 1022 - protein, 10 aa, Homo sapiens
  MISC_FEATURE: 20C3 VL CDR3
SSYAISSTLV

SEQ ID NO: 1023 - protein, 5 aa, Homo sapiens
  MISC_FEATURE: 20C3 VH CDR1
SYYWS

SEQ ID NO: 1024 - protein, 16 aa, Homo sapiens
  MISC_FEATURE: 20C3 VH CDR2
YISDSGSTNYNPSLKS

SEQ ID NO: 1025 - protein, 10 aa, Homo sapiens
  MISC_FEATURE: 20C3 VH CDR3
WQLAHDAFDI

SEQ ID NO: 1026 - protein, 114 aa, Homo sapiens
DIVMTQTPLSLPVTPGEPASISCRSSQSLLNSVDGSTNLDWYLQKPGQSPQLLIYTLSYRASGVPDRFSGSGSGTDFTLKISRVEAEDVGVYYCMQRIEFPLTFGGGTKVEIKR

SEQ ID NO: 1027 - protein, 120 aa, Homo sapiens
EVQLVESGGGLVQPGGSLRLSCAASGFTFSSYSMNWVRQAPGKGLEWVSYISSSGSSIYYADSVKGRFTISRDNAKNSLYLQMNSLRDEDTAVYYCARERYYGDTPFDYWGQGTLVTVSS

SEQ ID NO: 1028 - protein, 17 aa, Homo sapiens
  MISC_FEATURE: 27H6 VL CDR1
RSSQSLLNSVDGSTNLD

SEQ ID NO: 1029 - protein, 7 aa, Homo sapiens
  MISC_FEATURE: 27H6 VL CDR2
TLSYRAS

SEQ ID NO: 1030 - protein, 9 aa, Homo sapiens
  MISC_FEATURE: 27H6 VL CDR3
MQRIEFPLT

SEQ ID NO: 1031 - protein, 5 aa, Homo sapiens
  MISC_FEATURE: 27H6 VH CDR1
SYSMN

SEQ ID NO: 1032 - protein, 17 aa, Homo sapiens
  MISC_FEATURE: 27H6 VH CDR2
YISSSGSSIYYADSVKG

SEQ ID NO: 1033 - protein, 11 aa, Homo sapiens
  MISC_FEATURE: 27H6 VH CDR3
ERYYGDTPFDY

SEQ ID NO: 1034 - protein, 442 aa, Homo sapiens
QVQLVESGGGVVQPGRSLRLSCAASGFTFSRYDMHWVRQAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLKSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYDTTPPMLDSDGSFFLYSDLTVDKSRWQQGNVFSCSVMHEALHNHYTQKSLSLSPGK

SEQ ID NO: 1035 - protein, 214 aa, Homo sapiens
SYVLTQPPSVSVAPGQTARITCGGNNIGSKSVHWYQQKPGQAPVLVVYDDSDRPSEIPERFSGSNSGNTATLTISRVEAGDEADYYCQVWDSSSDHVVFGGGTRLTVLGQPKAAPSVTLFPPSSEELQANKATLVCLISDFYPGAVTVAWKADSSPVKAGVETTTPSKQSNNKYAAESYLSLTPEQWKSHRSYSCQVTHEGSTVEKTVAPTECS

SEQ ID NO: 1036 - protein, 440 aa, Homo sapiens
QVQLVESGGGVVQPGRSLRLSCAASGFTFSGYGMHWVRQAPGKGLEWVAVISYDGNDKYYADSVKGRFTISRDNAKNTLYLQMNSLRAEDTAVYYCARELRVLWGQGTLVTVSSASTKGPSVFPLAPCSRSTSESTAALGCLVKDYFPEPVTVSWNSGALTSGVHTFPAVLQSSGLYSLKSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYDTTPPMLDSDGSFFLYSDLTVDKSRWQQGNVFSCSVMHEALHNHYTQKSLSLSPGK

SEQ ID NO: 1037 - protein, 219 aa, Homo sapiens
DIVMTQTPLSLSVTPGQPASISCKSGQSLLHSDGKTYLYWYLQKPGQPPQFLIYEVSNRFSRVPDRFSGSGSGTDFTLRISRVEAEDVGIYYCMQSIQLPWTFGQGTQVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1038 - protein, 449 aa, Homo sapiens
EVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLESVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSRKEMTKNQVSLTCLVKGFYPSDIAVEWESNGQPENNYKTTPPMLKSDGSFFLYSKLTVDKSRWQQGNVFSCSVMHEALHNHYTQKSLSLSPGK

SEQ ID NO: 1039 - protein, 214 aa, Homo sapiens
DIQMTQSPSSLSASVGDRVTITCRASQDISNYLNWYQQKPGKAPKLLIYYTSRLLSGVPSRFSGSGSGTDFTLTISSLQPEDFATYYCQQGDTLPYTFGGGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 1040 - protein, 446 aa, Homo sapiens
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLESVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSRKEMTKNQVSLTCLVKGFYPSDIAVEWESNGQPENNYKTTPPMLKSDGSFFLYSKLTVDKSRWQQGNVFSCSVMHEALHNHYTQKSLSLSPGK

SEQ ID NO: 1041 - protein, 213 aa, Homo sapiens
DIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 1042 - protein, 442 aa, Homo sapiens
QVQLVESGGGVVQPGRSLRLSCAASGFTFSRYDMHWVRKAPGKGLEWVAIIFYDGSNKYYADPVKGRFTISRDNSKNTLYLQMNSLRAEDTAVYYCATLAAAFDYWGQGTLVTVSSASTKGPSVFPLAPCSRSTSESTAALGCLVKDYFPEPVTVSWNSGALTSGVHTFPAVLQSSGLYSLKSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYDTTPPMLDSDGSFFLYSDLTVDKSRWQQGNVFSCSVMHEALHNHYTQKSLSLSPGK

SEQ ID NO: 1043 - protein, 214 aa, Homo sapiens
SYVLTQPPSVSVAPGQTARITCGGNNIGSKSVHWYQEKPGQAPVLVVYDDSDRPSEIPERFSGSNSGNTATLTISRVEAGDEADYYCQVWDSSSDHVVFGGGTRLTVLGQPKAAPSVTLFPPSSEELQANKATLVCLISDFYPGAVTVAWKADSSPVKAGVETTTPSKQSNNKYAAESYLSLTPEQWKSHRSYSCQVTHEGSTVEKTVAPTECS

SEQ ID NO: 1044 - protein, 440 aa, Homo sapiens
QVQLVESGGGVVQPGRSLRLSCAASGFTFSGYGMHWVRKAPGKGLEWVAVISYDGNDKYYADSVKGRFTISRDNAKNTLYLQMNSLRAEDTAVYYCARELRVLWGQGTLVTVSSASTKGPSVFPLAPCSRSTSESTAALGCLVKDYFPEPVTVSWNSGALTSGVHTFPAVLQSSGLYSLKSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYDTTPPMLDSDGSFFLYSDLTVDKSRWQQGNVFSCSVMHEALHNHYTQKSLSLSPGK

SEQ ID NO: 1045 - protein, 219 aa, Homo sapiens
DIVMTQTPLSLSVTPGQPASISCKSGQSLLHSDGKTYLYWYLEKPGQPPQFLIYEVSNRFSRVPDRFSGSGSGTDFTLRISRVEAEDVGIYYCMQSIQLPWTFGQGTQVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1046 - protein, 449 aa, Homo sapiens
EVQLVQSGAEVKKPGASVKVSCKASGYTFTDYNMHWVREAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLESVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSRKEMTKNQVSLTCLVKGFYPSDIAVEWESNGQPENNYKTTPPMLKSDGSFFLYSKLTVDKSRWQQGNVFSCSVMHEALHNHYTQKSLSLSPGK

SEQ ID NO: 1047 - protein, 214 aa, Homo sapiens
DIQMTQSPSSLSASVGDRVTITCRASQDISNYLNWYQKKPGKAPKLLIYYTSRLLSGVPSRFSGSGSGTDFTLTISSLQPEDFATYYCQQGDTLPYTFGGGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 1048 - protein, 446 aa, Homo sapiens
EVQLVQSGAEVKKPGSSVKVSCKASGFTFTDYIMHWVREAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLESVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSRKEMTKNQVSLTCLVKGFYPSDIAVEWESNGQPENNYKTTPPMLKSDGSFFLYSKLTVDKSRWQQGNVFSCSVMHEALHNHYTQKSLSLSPGK

SEQ ID NO: 1049 - protein, 214 aa, Homo sapiens
CDIQMTQSPSSLSASVGDRVTITCRASQDISSYLNWYQKKPGKAPKLLIYSTSRLNSGVPSRFSGSGSGTDFTLTISSLQPEDFATYYCQQDIKHPTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

What is claimed is:

1. method of treating a bone gap defect in a mammalian subject comprising administering to the subject an antibody that binds to a region of sclerostin comprising amino acids 86-111 of SEQ ID NO: 1,
wherein the antibody comprises a first heavy chain and a first light chain comprising a sclerostin-binding portion and a second heavy chain and a second light chain comprising a DKK1-binding portion, wherein the first heavy chain comprises amino acid substitutions at EU positions 183, 356 and 399, wherein the second heavy chain comprises amino acid substitutions at EU positions 183, 392 and 409, and wherein the first and second light chains comprise an amino acid substitution at EU position 176, wherein the amino acid substitutions introduce a charged amino acid at said positions, wherein the substitution introduce charged amino acids that are electrostatically unfavorable to homodimer formation and electrostatically favorable to heterodimer formation, wherein the antibody is administered in an amount effective to treat the gap defect in the subject.

2. The method of claim 1, wherein the negative charged amino acid at one or more of EU positions D399, E356 and E357 in the CH3 domain are substituted with a positive charged amino acid.

3. The method of claim 1, wherein the positive charged amino acids at one or more of EU positions K370, K392 and K409 in the CH3domain are each substituted with a negative charged amino acid.

4. The method of claim 1, wherein the antibody comprises a set of six CDRs selected from the group consisting of a) CDR sequences of SEQ ID NOs:54, 55, and 56 and CDR sequences of SEQ ID NOs:51, 52, and 53; b) CDR sequences of SEQ ID NOs:60, 61, and 62 and CDR sequences of SEQ ID NOs:57, 58, and 59; c) CDR sequences of SEQ ID NOs:48, 49, and 50 and CDR sequences of SEQ ID NOs: 45, 46, and 47; d) CDR sequences of SEQ ID NOs:42, 43, and 44 and CDR sequences of SEQ ID NOs:39, 40, and 41; e) CDR sequences of SEQ ID NOs:275, 276, and 277and CDR sequences of SEQ ID NOs:287, 288, and 289; f) CDR sequences of SEQ ID NOs:278, 279, and 280 and CDR sequences of SEQ ID NOs:290, 291, and 292; g) CDR sequences of SEQ ID NOs:78, 79, and 80 and CDR sequences of SEQ ID NOs: 245, 246, and 247; h) CDR sequences of SEQ ID NOs:81, 99, and 100 and CDR sequences of SEQ ID NOs:248, 249, and 250; i) CDR sequences of SEQ ID NOs:101, 102, and 103 and CDR sequences of SEQ ID NOs:251, 252, and 253; j) CDR sequences of SEQ ID NOs:104, 105, and 106 and CDR sequences of SEQ ID NOs:254, 255, and 256; k) CDR sequences of SEQ ID NOs:107, 108, and 109 and CDR sequences of SEQ ID NOs:257, 258, and 259; l) CDR sequences of SEQ ID NOs:110, 111, and 112 and CDR sequences of SEQ ID NOs:260, 261, and 262; m) CDR sequences of SEQ ID NOs:281, 282, and 283 and CDR sequences of SEQ ID NOs:293, 294, and 295; n) CDR sequences of SEQ ID NOs:113, 114, and 115 and CDR sequences of SEQ ID NOs:263, 264, and 265; o) CDR sequences of SEQ ID NOs:284, 285, and 286 and CDR sequences of SEQ ID NOs:296, 297, and 298; p) CDR sequences of SEQ ID NOs:116, 237, and 238 and CDR sequences of SEQ ID NOs:266, 267, and 268; q) CDR sequences of SEQ ID NOs:239, 240, and 241 and CDR sequences of SEQ ID NOs:269, 270, and 271) CDR sequences of SEQ ID NOs:242, 243, and 244 and CDR sequences of SEQ ID NOs:272, 273, and 274; and s) CDR sequences of SEQ ID NOs:351, 352, and 353and CDR sequences of SEQ ID NOs:358, 359, and 360.

5. The method of claim 1, wherein the antibody comprises a light chain comprising a variable region amino acid sequence selected from the group consisting of SEQ ID NO: 364, SEQ ID NO: 376, SEQ ID NO: 75, SEQ ID NO: 384, SEQ ID NO: 388, SEQ ID NO: 380, SEQ ID NO: 299, SEQ ID NO: 303, SEQ ID NO: 314, SEQ ID NO: 311, SEQ ID NO: 315 and SEQ ID NO: 368.

6. The method of claim 1, wherein the antibody comprises a heavy chain comprising a variable region amino acid sequence selected from the group consisting of SEQ ID NO: 366, SEQ ID NO: 378, SEQ ID NO: 77, SEQ ID NO: 386, SEQ ID NO: 390, SEQ ID NO: 382, SEQ ID NO: 301, SEQ ID NO: 305, SEQ ID NO: 327, SEQ ID NO: 313, SEQ ID NO: 317 and SEQ ID NO: 370.

7. The method of claim 1, wherein the antibody comprises a first heavy chain and a first light chain comprising a sclerostin-binding portion and a second heavy chain and a second light chain comprising a DKK1-binding portion, wherein the first heavy chain comprises amino acid substitutions at AHo position 46 and EU positions 183, 356 and 399, wherein the second heavy chain comprises amino acid substitutions at AHo position 46 and EU positions 183, 392 and 409, wherein the first and second light chains comprise an amino acid substitution at AHo position 46 and EU position 176, and wherein the amino acid substitutions introduce a charged amino acid at said positions.

8. The method of claim 1, wherein the sclerostin-binding portion comprises a set of six CDRs selected from the group consisting of a) CDR sequences of SEQ ID NOs:54, 55, and 56 and CDR sequences of SEQ ID NOs:51, 52, and 53; b) CDR sequences of SEQ ID NOs:60, 61, and 62 and CDR sequences of SEQ ID NOs:57, 58, and 59; c) CDR sequences of SEQ ID NOs:48, 49, and 50 and CDR sequences of SEQ ID NOs: 45, 46, and 47; d) CDR sequences of SEQ ID NOs:42, 43, and 44 and CDR sequences of SEQ ID NOs:39, 40, and 41; e) CDR sequences of SEQ ID NOs:275, 276, and 277 and CDR sequences of SEQ ID NOs:287, 288, and 289; f) CDR sequences of SEQ ID NOs:278, 279, and 280 and CDR sequences of SEQ ID NOs:290, 291, and 292; g) CDR sequences of SEQ ID NOs:78, 79, and 80 and CDR sequences of SEQ ID NOs: 245, 246, and 247; h) CDR sequences of SEQ ID NOs:81, 99, and 100 and CDR sequences of SEQ ID NOs:248, 249, and 250; i) CDR sequences of SEQ ID NOs:101, 102, and 103and CDR sequences of SEQ ID NOs:251, 252, and 253; j) CDR sequences of SEQ ID NOs:104, 105, and 106 and CDR sequences of SEQ ID NOs:254, 255, and 256; k) CDR sequences of SEQ ID NOs:107, 108, and 109 and CDR sequences of SEQ ID NOs:257, 258, and 259; l) CDR sequences of SEQ ID NOs:110, 111, and 112 and CDR sequences of SEQ ID NOs:260, 261, and 262; m) CDR sequences of SEQ ID NOs:281, 282, and 283 and CDR sequences of SEQ ID NOs:293, 294, and 295; n) CDR sequences of SEQ ID NOs:113, 114, and 115and CDR sequences of SEQ ID NOs:263, 264, and 265; o) CDR sequences of SEQ ID NOs:284, 285, and 286 and CDR sequences of SEQ ID NOs:296, 297, and 298; p) CDR sequences of SEQ ID NOs:116, 237, and 238 and CDR sequences of SEQ ID NOs:266, 267, and 268; q) CDR sequences of SEQ ID NOs:239, 240, and 241 and CDR sequences of SEQ ID NOs:269, 270, and 271) CDR sequences of SEQ ID NOs:242, 243, and 244and CDR sequences of SEQ ID NOs:272, 273, and 274; or s) CDR sequences of SEQ ID NOs:351, 352, and 353 and CDR sequences of SEQ ID NOs:358, 359, and 360.

9. The method of claim 1, wherein the sclerostin-binding portion comprises a set of six CDRs selected from the group consisting of a) CDR-L1 of SEQ ID NO: 284, CDR-L2 of SEQ ID NO: 285, CDR-L3 of SEQ ID NO: 286, CDR-H1 of SEQ ID NO: 296, CDR-H2 of SEQ ID NO: 297, and CDR-H3 of SEQ ID NO: 298; b) CDR-L1 of SEQ ID NO: 48, CDR-L2 of SEQ ID NO: 49, CDR-L3 of SEQ ID NO: 50, CDR-H1 of SEQ ID NO: 45, CDR-H2 of SEQ ID NO: 46, and CDR-H3 of SEQ ID NO: 47; or c) CDR-L1 of SEQ ID NO: 42, CDR-L2 of SEQ ID NO: 43, CDR-L3 of SEQ ID NO: 44, CDR-H1of SEQ ID NO: 39, CDR-H2 of SEQ ID NO: 40, and CDR-H3 of SEQ ID NO: 41.

10. The method of claim 1, wherein the sclerostin-binding portion comprises a heavy chain and a light chain comprising CDR-H1 of SEQ ID NO: 269, CDR-H2 of SEQ ID NO: 270, CDR-H3 of SEQ ID NO: 271, CDR-L1 of SEQ ID NO: 239, CDR-L2 of SEQ ID NO: 240 and CDR-L3 of SEQ ID NO: 241.

11. The method of claim 1, wherein the first light chain comprises a variable region amino acid sequence selected from the group consisting of SEQ ID NO: 364, SEQ ID NO: 376, SEQ ID NO: 75, SEQ ID NO: 384, SEQ ID NO: 388, SEQ ID NO: 380, SEQ ID NO: 299, SEQ ID NO: 303, SEQ ID NO: 314, SEQ ID NO: 311, SEQ ID NO: 315 and SEQ ID NO: 368.

12. The method of claim 1, wherein the first heavy chain comprises a variable region amino acid sequence selected from the group consisting of SEQ ID NO: 366, SEQ ID NO: 378, SEQ ID NO: 77, SEQ ID NO: 386, SEQ ID NO: 390, SEQ ID NO: 382, SEQ ID NO: 301, SEQ ID NO: 305, SEQ ID NO: 327, SEQ ID NO: 313, SEQ ID NO: 317 and SEQ ID NO: 370.

13. The method of claim 1, wherein the DKK1-binding portion comprises a set of six CDRs selected from the group consisting of (a) SEQ ID NOs: 820-825, (b) SEQ ID NOs: 828-833, (c) SEQ ID NOs: 836-841, (d) SEQ ID NOs: 844-849, (e) SEQ ID NOs: 852-857, (f) SEQ ID NOs: 860-865, (g) SEQ ID NOs: 868-873, (h) SEQ ID NOs: 876-881, (i) SEQ ID NOs: 884-889, (j) SEQ ID NOs: 892-897, (k) SEQ ID NOs: 900-905, (l) SEQ ID NOs: 908-913, (m) SEQ ID NOs: 916-921, (n) SEQ ID NOs: 924-929, (o) SEQ ID NOs: 932-937, (p) SEQ ID NOs: 940-945, (q) SEQ ID NOs: 948-953, (r) SEQ ID NOs: 956-961, (s) SEQ ID NOs: 964-969, (t) SEQ ID NOs: 972-977, (u) SEQ ID NOs: 980-985, (v) SEQ ID NOs: 988-993, (w) SEQ ID NOs: 996-1001, and (x) SEQ ID NOs: 1004-1009.

14. The method of claim 1, wherein the DKK1-binding portion comprises a set of six CDRs selected from the group consisting of SEQ ID NOs: 980-985 and SEQ ID NOs: 1004-1009.

15. The method of claim 1, wherein the second light chain comprises a variable region amino acid sequence selected from the group consisting of SEQ ID NO: 818, SEQ ID NO: 826, SEQ ID NO: 834, SEQ ID NO: 842, SEQ ID NO: 850, SEQ ID NO: 866, SEQ ID NO: 874, SEQ ID NO: 882, SEQ ID NO: 890, SEQ ID NO: 898, SEQ ID NO: 906, SEQ ID NO: 814, SEQ ID NO: 822, SEQ ID NO: 830, SEQ ID NO: 938, SEQ ID NO: 946, SEQ ID NO: 954, SEQ ID NO: 962, SEQ ID NO: 970, SEQ ID NO: 978, SEQ ID NO: 988, SEQ ID NO: 994 and SEQ ID NO: 1002.

16. The method of claim 1, wherein the second heavy chain comprises a variable region amino acid sequence selected from the group consisting of SEQ ID NO: 819, SEQ ID NO: 827, SEQ ID NO: 835, SEQ ID NO: 843, SEQ ID NO: 851, SEQ ID NO: 859, SEQ ID NO: 867, SEQ ID NO: 875, SEQ ID NO: 883, SEQ ID NO: 891, SEQ ID NO: 899, SEQ ID NO: 907, SEQ ID NO: 915, SEQ ID NO: 923, SEQ ID NO: 931, SEQ ID NO: 939, SEQ ID NO: 947, SEQ ID NO: 955, SEQ ID NO: 963, SEQ ID NO: 971, SEQ ID NO: 979, SEQ ID NO: 987, SEQ ID NO: 995 and SEQ ID NO: 1003.

17. The method of claim 1, wherein the antibody comprises
a first heavy chain comprising a variable region amino acid sequence selected from the group consisting of SEQ ID NOs: 378 and 366 and comprising amino acid substitutions at EU positions 183, 356 and 399 of the first heavy chain,
a second heavy chain comprising a variable region amino acid sequence selected from the group consisting of SEQ ID NOs: 1003 and 979 and comprising amino acid substitutions at EU positions 183, 392 and 409 of the second heavy chain,
a first light chain comprising a variable region amino acid sequence selected from the group consisting of SEQ ID NOs: 376 and 364 and comprising an amino acid substitution at EU position 176 of the first light chain, and
a second light chain comprising a variable region amino acid sequence selected from the group consisting of SEQ ID NOs: 1002 and 978 and comprising an amino acid substitution at EU position 176 of the second light chain;
wherein the amino acid substitutions introduce a charged amino acid at said positions.

18. The method of claim 1, wherein the antibody comprises
(a) a first heavy chain comprising the amino acid sequence set forth in SEQ ID NO: 1038; a second heavy chain comprising the amino acid sequence set forth in SEQ ID NO: 1034; a first light chain comprising the amino acid sequence set forth in SEQ ID NO: 1039 and a second light chain comprising the amino acid sequence set forth in SEQ ID NO: 1035;
(b) a first heavy chain comprising the amino acid sequence set forth in SEQ ID NO: 1038; a second heavy chain comprising the amino acid sequence set forth in SEQ ID NO: 1036; a first light chain comprising the amino acid sequence set forth in SEQ ID NO: 1039and a second light chain comprising the amino acid sequence set forth in SEQ ID NO: 1037;
(c) a first heavy chain comprising the amino acid sequence set forth in SEQ ID NO: 1040; a second heavy chain comprising the amino acid sequence set forth in SEQ ID NO: 1034; a first light chain comprising the amino acid sequence set forth in SEQ ID NO: 1041 and a second light chain comprising the amino acid sequence set forth in SEQ ID NO: 1035;
(d) a first heavy chain comprising the amino acid sequence set forth in SEQ ID NO: 1040; a second heavy chain comprising the amino acid sequence set forth in SEQ ID NO: 1036; a first light chain comprising the amino acid sequence set forth in SEQ ID NO: 1041 and a second light chain comprising the amino acid sequence set forth in SEQ ID NO: 1037;
(e) a first heavy chain comprising the amino acid sequence set forth in SEQ ID NO: 1046; a second heavy chain comprising the amino acid sequence set forth in SEQ ID NO: 1042; a first light chain comprising the amino acid sequence set forth in SEQ ID NO: 1047 and a second light chain comprising the amino acid sequence set forth in SEQ ID NO: 1043;
(f) a first heavy chain comprising the amino acid sequence set forth in SEQ ID NO: 1046; a second heavy chain comprising the amino acid sequence set forth in SEQ ID NO: 1044; a first light chain comprising the amino acid sequence set forth in SEQ ID NO: 1047 and a second light chain comprising the amino acid sequence set forth in SEQ ID NO: 1045;
(g) a first heavy chain comprising the amino acid sequence set forth in SEQ ID NO: 1048; a second heavy chain comprising the amino acid sequence set forth in SEQ ID NO: 1042; a first light chain comprising the amino acid sequence set forth in SEQ ID NO: 1049 and a second light chain comprising the amino acid sequence set forth in SEQ ID NO: 1043; or
(h) a first heavy chain comprising the amino acid sequence set forth in SEQ ID NO: 1048; a second heavy chain comprising the amino acid sequence set forth in SEQ ID NO: 1044; a first light chain comprising the amino acid sequence set forth in SEQ ID NO: 1049 and a second light chain comprising the amino acid sequence set forth in SEQ ID NO: 1045.

19. The method of claim 1, wherein the antibody comprises (a) a heavy chain that comprises an amino acid sequence selected from the group consisting of SEQ ID NO: 1038, SEQ ID NO: 1046, SEQ ID NO: 1040 and SEQ ID NO: 1048, optionally further comprising a light chain amino acid sequence selected from the group consisting of SEQ ID NO: 1039, SEQ ID NO: 1047, SEQ ID NO: 1041 and SEQ ID NO: 1049; or (b) a heavy chain that comprises an amino acid sequence selected from the group consisting of SEQ ID NO: 1034, SEQ ID NO: 1042, SEQ ID NO: 1036 and SEQ ID NO: 1044, optionally further comprising a light chain amino acid sequence selected from the group consisting of SEQ ID NO: 1035, SEQ ID NO: 1043, SEQ ID NO: 1037 and SEQ ID NO: 1045.

* * * * *

UNITED STATES PATENT AND TRADEMARK OFFICE
CERTIFICATE OF CORRECTION

PATENT NO. : 9,822,173 B2  
APPLICATION NO. : 14/443107  
DATED : November 21, 2017  
INVENTOR(S) : Gunasekaran Kannan et al.

Page 1 of 1

It is certified that error appears in the above-identified patent and that said Letters Patent is hereby corrected as shown below:

In the Claims

At Column 97, Line 56, "method" should be -- A method --.

At Column 98, Line 57, "substitution" should be -- substitutions --.

Signed and Sealed this
Twenty-first Day of April, 2020

Andrei Iancu
*Director of the United States Patent and Trademark Office*